United States Patent 7,745,391 (HUMAN THROMBOSPONDIN POLYPEPTIDE) - sequence listing, part 97

SEQ ID NO: 306972 - DNA, 2405 bp, Homo sapiens
atttgttcgttcttctgttttcctctttttgttcgttctttttgtttcttcttgctgtcgcgtgtctgcttctcgtcctgttcttctcctgcgtctgctcgggcttattttataatccttgtctctcctttgtccctccggttgtgtatactgtcccgctgtttgttctctcccgtggttcccttctttcgagattttggtttctcacaatcctgctcttgtgttttctctctcccccgcttttttttatttgtgtggatattcccctccgttatttgtgtgccgcggtgcttctcctgggtatctctttttgtctactgttctaccttgacccttgtggtgccccctcgtcgtcactactcttgttttctataaacctttttctcggtcccctctttctcgccaaacaattttttttttttttctttttttttttttttttttcacattgtaaaatatagtttacttcaaaagatgatcctgaagatcccatcacagagtgtttaagggatgattataaacttttagcccttaagagagaatatatatactcaactgagtactgtctttcaaagcagtccctgtcagtttgtccattgattccatagcagctctcactgcccaccctgcttgagaagcctcttggagttgcctagagagtctatagcactcatctgaaggccctccatgagaacaactcttctcttccacatagatatttttgcatcagcccaaagctatttggacacaagtttggtgaacacggtaagaaaaaaacaaaccaagcaacaaaaacaaaaagcaggcagtgctgtgttagactgaaagtaaaagataaaaactctaagaacctatgaagcgccagggcagtgctggttgctttcacccatatggtctcctttggtgttctgctggtgcttatgaagcagtatccctactgacaatgaccctagcttaagagggctgagaactgctgaaagtgaagctgtttataaatggtacagtcaggaccgacagacacatgggtgtggtatgactgcaaagtacctgtggaattcagatgggattaccatccccactataaagggcaatatgatctgttgcaggagggtttatagggtacttagttacacaggtcacactgatccccttttcctctttttttctatgcaagtatctatttgtctatatgtctgtctaccttggtaggttgggctccttgaagaagggttatgttttcttcatctccatatccccagtagctggccaatgcccagtatacaccaggggctcagtcgctgtttgtcttattttcttgttgactctactctgacttaggacatatcactttcctctcttgaccttcacattcagatgtgttaataaaagtggataaagaccactctagctttaaaacaccctccaatatagagagaactctgaaaccagaagcagaagctgaggaatggtgaatagagcattttccctcacacgatgggtatcagggtggtttcttgtcctttcaatgcctctgcagaacttgaccctagtttttcaaattggactcaagaatgatcttagtgttggtggttttgtggttttctttgagactttgttattgacagaacagcttctggaaatctttttcaccgggagtatgggggcttctttggccaaaccgtgcgcgtgcaggctccatgtgctgggcagcagctgtccggccacagcctgtcggttgcatcctgctcctctacagaggtttctgtgctctcaagacagtctcttccgtgacgagcaggcgcttagggctacctgtaccttcagacattatggtgtgtttggccatgtcatttgtcataggtgtaaaaaccacaaccgagagcccgaagctgctgggatgagcacctgccgcggaactgcattctcgcgctccttcctgctctttccaagaagccaggcgcggccggccagcatcccgctctcccggaccccgcagtcagtgtgggcagcaggcccagagtggtgcgagccgacggcggcgttagaaaggcggcgtcccgacgaacagagtgactcggcctcggctccccttcaaagcgccatcttatcgctgcttccctcaggagcaggcgagctcttccccaggacctgcttcgcggcttcccttcgcccgagaaccaccgggcggaggcggcggcctctctggccctgccgggaacagggcgcaggggaggggagcggcggccgaccggcctgaggcgggcgaacggcctctggcctccaggcgctgcctgctccggctcagaagcctcccggatcccgtcccggcccaactccgggcctccgcctccgccgccgcctccgggagccccgagccgcgtcccgccggcgccgcctcttccgcc

SEQ ID NO: 306973 - DNA, 2608 bp, Homo sapiens
atttgttcgttcttctgttttcctctttttgttcgttctttttgtttcttcttgctgtcgcgtgtctgcttctcgtcctgttcttctcctgcgtctgctcgggcttattttataatccttgtctctcctttgtccctccggttgtgtatactgtcccgctgtttgttctctcccgtggttcccttctttcgagattttggtttctcacaatcctgctcttgtgttttctctctcccccgcttttttttatttgtgtggatattcccctccgttatttgtgtgccgcggtgcttctcctgggtatctctttttgtctactgttctaccttgacccttgtggtgccccctcgtcgtcactactcttgttttctataaacctttttctcggtcccctctttctcgccaaacaattttttttttttttctttttttttttttttttttcacattgtaaaatatagtttacttcaaaagatgatcctgaagatcccatcacagagtgtttaagggatgattataaacttttagcccttaagagagaatatatatactcaactgagtactgtctttcaaagcagtccctgtcagtttgtccattgattccatagcagctctcactgcccaccctgcttgagaagcctcttggagttgcctagagagtctatagcactcatctgaaggccctccatgagaacaactcttctcttccacatagatatttttgcatcagcccaaagctatttggacacaagtttggtgaacacggtaagaaaaaaacaaaccaagcaacaaaaacaaaaagcaggcagtgctgtgttagactgaaagtaaaagataaaaactctaagaacctatgaagcgccagggcagtgctggttgctttcacccatatggtctcctttggtgttctgctggtgcttatgaagcagtatccctactgacaatgaccctagcttaagagggctgagaactgctgaaagtgaagctgtttataaatggtacagtcaggaccgacagacacatgggtgtggtatgactgcaaagtacctgtggaattcagatgggattaccatccccactataaagggcaatatgatctgttgcaggagggtttatagggtacttagttacacaggtcacactgatccccttttcctctttttttctatgcaagtatctatttgtctatatgtctgtctaccttggtaggttgggctccttgaagaagggttatgttttcttcatctccatatccccagtagctggccaatgcccagtatacaccaggggctcagtcgctgtttgtcttattttcttgttgactctactctgacttaggacatatcactttcctctcttgaccttcacattcagatgtgttaataaaagtggataaagaccactctagctttaaaacaccctccaatatagagagaactctgaaaccagaagcagaagctgaggaatggtgaatagagcattttccctcacacgatgggtatcagggtggtttcttgtcctttcaatgcctctgcagaacttgaccctagtttttcaaattggactcaagaatgatcttagtgttggtggttttgtggttttctttgagactttgttattgacagaacagcttctggaaatctttttcaccgggagtatgggggcttctttggccaaaccgtgcgcgtgcaggctccatgtgctgggcagcagctgtccggccacagcctgtcggttgcatcctgctcctctacagaggtttagtatcaacctcattttagaagcagttacgacagagctttggaacagaatttacgtaaacgacctccttccagaagatgctactaaagcaacaagattcaaatccctctccctcagaagagctgggagatccactgcaaaggcgcacgtttcagtctagccattgcgcagtggtaacgcaggctttcccacgctgcaacagacctgtgctctcaagacagtctcttccgtgacgagcaggcgcttagggctacctgtaccttcagacattatggtgtgtttggccatgtcatttgtcataggtgtaaaaaccacaaccgagagcccgaagctgctgggatgagcacctgccgcggaactgcattctcgcgctccttcctgctctttccaagaagccaggcgcggccggccagcatcccgctctcccggaccccgcagtcagtgtgggcagcaggcccagagtggtgcgagccgacggcggcgttagaaaggcggcgtcccgacgaacagagtgactcggcctcggctccccttcaaagcgccatcttatcgctgcttccctcaggagcaggcgagctcttccccaggacctgcttcgcggcttcccttcgcccgagaaccaccgggcggaggcggcggcctctctggccctgccgggaacagggcgcaggggaggggagcggcggccgaccggcctgaggcgggcgaacggcctctggcctccaggcgctgcctgctccggctcagaagcctcccggatcccgtcccggcccaactccgggcctccgcctccgccgccgcctccgggagccccgagccgcgtcccgccggcgccgcctcttccgcc

SEQ ID NO: 306974 - DNA, 2160 bp, Homo sapiens
atttgttcgttcttctgttttcctctttttgttcgttctttttgtttcttcttgctgtcgcgtgtctgcttctcgtcctgttcttctcctgcgtctgctcgggcttattttataatccttgtctctcctttgtccctccggttgtgtatactgtcccgctgtttgttctctcccgtggttcccttctttcgagattttggtttctcacaatcctgctcttgtgttttctctctcccccgcttttttttatttgtgtggatattcccctccgttatttgtgtgccgcggtgcttctcctgggtatctctttttgtctactgttctaccttgacccttgtggtgccccctcgtcgtcactactcttgttttctataaacctttttctcggtcccctctttctcgccaaacaattttttttttttttctttttttttttttttttttcacattgtaaaatatagtttacttcaaaagatgatcctgaagatcccatcacagagtgtttaagggatgattataaacttttagcccttaagagagaatatatatactcaactgagtactgtctttcaaagcagtccctgtcagtttgtccattgattccatagcagctctcactgcccaccctgcttgagaagcctcttggagttgcctagagagtctatagcactcatctgaaggccctccatgagaacaactcttctcttccacatagatatttttgcatcagcccaaagctatttggacacaagtttggtgaacacggtaagaaaaaaacaaaccaagcaacaaaaacaaaaagcaggcagtgctgtgttagactgaaagtaaaagataaaaactctaagaacctatgaagcgccagggcagtgctggttgctttcacccatatggtctcctttggtgttctgctggtgcttatgaagcagtatccctactgacaatgaccctagcttaagagggctgagaactgctgaaagtgaagctgtttataaatggtacagtcaggaccgacagacacatgggtgtggtatgactgcaaagtacctgtggaattcagatgggattaccatccccactataaagggcaatatgatctgttgcaggagggtttatagggtacttagttacacaggtcacactgatccccttttcctctttttttctatgcaagtatctatttgtctatatgtctgtctaccttggtaggttgggctccttgaagaagggttatgttttcttcatctccatatccccagtagctggccaatgcccagtatacaccaggggctcagtcgctgtttgtcttattttcttgttgactctactctgacttaggacatatcactttcctctcttgaccttcacattcagatgtgttaataaaagtggataaagaccactctagctttaaaacaccctccaatatagagagaactctgaaaccagaagcagaagctgaggaatggtgaatagagcattttccctcacacgatgggtatcagggtggtttcttgtcctttcaatgcctctgcagaacttgaccctagtttttcaaattggactcaagaatgatcttagtgttggtggttttgtggttttctttgagactttgttattgacagaacagcttctggaaatctttttcaccgggagtatgggggcttctttggccaaaccgtgcgcgtgcaggctccatgtgctgggcagcagctgtccggccacagcctgtcggttgcatcctgctcctctacagaggtttctggcggcgctggccaaggcctgcttcggcggcaacatcgagctcttcgtcttcttcaacggcgcgctcgagaaggcccggctgcacgagtgggtcaagcggcagggcaacgagcgccagacggcacagcagatcgtcagccatgtccagaacaagggcaccccgccgccaaaggtctggttcctgccgcccgtctgcatggcccactgcatccgcctggcgctcatccgcttccacgtcaaggttgcacagagcattgaggatcaccatcaggaagtgattggtttctgcagagagaatggtttccatggcttggttgcgtatgactctgattatgcactgtgcaacatcccctactatttcagtgcccaccccccgcgtagctcatatagtcctgg

SEQ ID NO: 306975 - DNA, 2386 bp, Homo sapiens
atttgttcgttcttctgttttcctctttttgttcgttctttttgtttcttcttgctgtcgcgtgtctgcttctcgtcctgttcttctcctgcgtctgctcgggcttattttataatccttgtctctcctttgtccctccggttgtgtatactgtcccgctgtttgttctctcccgtggttcccttctttcgagattttggtttctcacaatcctgctcttgtgttttctctctcccccgcttttttttatttgtgtggatattcccctccgttatttgtgtgccgcggtgcttctcctgggtatctctttttgtctactgttctaccttgacccttgtggtgccccctcgtcgtcactactcttgttttctataaacctttttctcggtcccctctttctcgccaaacaattttttttttttttctttttttttttttttttttcacattgtaaaatatagtttacttcaaaagatgatcctgaagatcccatcacagagtgtttaagggatgattataaacttttagcccttaagagagaatatatatactcaactgagtactgtctttcaaagcagtccctgtcagtttgtccattgattccatagcagctctcactgcccaccctgcttgagaagcctcttggagttgcctagagagtctatagcactcatctgaaggccctccatgagaacaactcttctcttccacatagatatttttgcatcagcccaaagctatttggacacaagtttggtgaacacggtaagaaaaaaacaaaccaagcaacaaaaacaaaaagcaggcagtgctgtgttagactgaaagtaaaagataaaaactctaagaacctatgaagcgccagggcagtgctggttgctttcacccatatggtctcctttggtgttctgctggtgcttatgaagcagtatccctactgacaatgaccctagcttaagagggctgagaactgctgaaagtgaagctgtttataaatggtacagtcaggaccgacagacacatgggtgtggtatgactgcaaagtacctgtggaattcagatgggattaccatccccactataaagggcaatatgatctgttgcaggagggtttatagggtacttagttacacaggtcacactgatccccttttcctctttttttctatgcaagtatctatttgtctatatgtctgtctaccttggtaggttgggctccttgaagaagggttatgttttcttcatctccatatccccagtagctggccaatgcccagtatacaccaggggctcagtcgctgtttgtcttattttcttgttgactctactctgacttaggacatatcactttcctctcttgaccttcacattcagatgtgttaataaaagtggataaagaccactctagctttaaaacaccctccaatatagagagaactctgaaaccagaagcagaagctgaggaatggtgaatagagcattttccctcacacgatgggtatcagggtggtttcttgtcctttcaatgcctctgcagaacttgaccctagtttttcaaattggactcaagaatgatcttagtgttggtggttttgtggttttctttgagactttgttattgacagaacagcttctggaaatctttttcaccgggagtatgggggcttctttggccaaaccgtgcgcgtgcaggctccatgtgctgggcagcagctgtccggccacagcctgtcggttgcatcctgctcctctacagaggtttctggcggcgctggccaaggcctgcttcggcggcaacatcgagctcttcgtcttcttcaacggcgcgctcgagaaggcccggctgcacgagtgggtcaagcggcagggcaacgagcgccagacggcacagcagatcgtcagccatgtccagaacaagggcaccccgccgccaaaggtctggttcctgccgcccgtctgcatggcccactgcatccgcctggcgctcatccgcttccacgtcaaggttgcacagagcattgaggatcaccatcaggaagtgattggtttctgcagagagaatggtttccatggcttggttgcgtatgactctgattatgcactgtgcaacatcccctactatttcagtgcccatgccctaaaactgagccggaacgggaaaagtctcaccacaagccaatatctgatgcatgaagttgccaagcaactggacctgaatccaaatcgttttcctatttttgctgctctcttaggtaggtggagcagtgtgaaaatattttataagggagtgaccatatgataagcacattgattcttccttagcattccttgcttcgtattattttttggcatagctaatgtgctacttttgttcttaagtgtttgt

SEQ ID NO: 306976 - DNA, 2548 bp, Homo sapiens
atttgttcgttcttctgttttcctctttttgttcgttctttttgtttcttcttgctgtcgcgtgtctgcttctcgtcctgttcttctcctgcgtctgctcgggcttattttataatccttgtctctcctttgtccctccggttgtgtatactgtcccgctgtttgttctctcccgtggttcccttctttcgagattttggtttctcacaatcctgctcttgtgttttctctctcccccgcttttttttatttgtgtggatattcccctccgttatttgtgtgccgcggtgcttctcctgggtatctctttttgtctactgttctaccttgacccttgtggtgccccctcgtcgtcactactcttgttttctataaacctttttctcggtcccctctttctcgccaaacaattttttttttttttctttttttttttttttttttcacattgtaaaatatagtttacttcaaaagatgatcctgaagatcccatcacagagtgtttaagggatgattataaacttttagcccttaagagagaatatatatactcaactgagtactgtctttcaaagcagtccctgtcagtttgtccattgattccatagcagctctcactgcccaccctgcttgagaagcctcttggagttgcctagagagtctatagcactcatctgaaggccctccatgagaacaactcttctcttccacatagatatttttgcatcagcccaaagctatttggacacaagtttggtgaacacggtaagaaaaaaacaaaccaagcaacaaaaacaaaaagcaggcagtgctgtgttagactgaaagtaaaagataaaaactctaagaacctatgaagcgccagggcagtgctggttgctttcacccatatggtctcctttggtgttctgctggtgcttatgaagcagtatccctactgacaatgaccctagcttaagagggctgagaactgctgaaagtgaagctgtttataaatggtacagtcaggaccgacagacacatgggtgtggtatgactgcaaagtacctgtggaattcagatgggattaccatccccactataaagggcaatatgatctgttgcaggagggtttatagggtacttagttacacaggtcacactgatccccttttcctctttttttctatgcaagtatctatttgtctatatgtctgtctaccttggtaggttgggctccttgaagaagggttatgttttcttcatctccatatccccagtagctggccaatgcccagtatacaccaggggctcagtcgctgtttgtcttattttcttgttgactctactctgacttaggacatatcactttcctctcttgaccttcacattcagatgtgttaataaaagtggataaagaccactctagctttaaaacaccctccaatatagagagaactctgaaaccagaagcagaagctgaggaatggtgaatagagcattttccctcacacgatgggtatcagggtggtttcttgtcctttcaatgcctctgcagaacttgaccctagtttttcaaattggactcaagaatgatcttagtgttggtggttttgtggttttctttgagactttgttattgacagaacagcttctggaaatctttttcaccgggagtatgggggcttctttggccaaaccgtgcgcgtgcaggctccatgtgctgggcagcagctgtccggccacagcctgtcggttgcatcctgctcctctacagaggtttcttcaactttgacaaaatactcccttttctaatttagcctgttctttcccagcaacaggttcatcttggaagcaggcaggatacagagtaatagagggggtttcgccagagcccttgggggctgcaaatatcagtgctgctgccgccgcccttgccaatgttgttagcccggtgacagcgagacgtgtctaagggccagtgccctggcctctacttcagaacgcagtgccctgtccgtgttcctcttagtacagggtgtttagagaatctttctatggctttttgtgttagatttcaaagacccgtgcactttgacaggatgggattttgtcagttctgtgacttcacgtccgtgtgaaagaggtctttaaggcagttcggttttgtagatcccatgcgaaaggagtcgctcaaaatcagggggcgaactacgcgggcgtgaactcgcaggatttatttttcgggtgcacagtaagtattcagtgaccttcagcggtgccctgacgggtgggtaatcagagctctatatcaccggcctcctctggccctttggcagagggcttcgcagctggcactgggccagaggagaacttcaggacccagcagtgactgtgaagataagcacatccatgatcctggacttcacgttctgattgcttgcttttttcattggttttcttgaaaacaattttgggggcctttttgttgtcttagctcttgacactcggtcttccatcttgtcatttgacatttccttgaaactgctggagctgaaagtttgtgaaa

SEQ ID NO: 306977 - DNA, 2526 bp, Homo sapiens
atttgttcgttcttctgttttcctctttttgttcgttctttttgtttcttcttgctgtcgcgtgtctgcttctcgtcctgttcttctcctgcgtctgctcgggcttattttataatccttgtctctcctttgtccctccggttgtgtatactgtcccgctgtttgttctctcccgtggttcccttctttcgagattttggtttctcacaatcctgctcttgtgttttctctctcccccgcttttttttatttgtgtggatattcccctccgttatttgtgtgccgcggtgcttctcctgggtatctctttttgtctactgttctaccttgacccttgtggtgccccctcgtcgtcactactcttgttttctataaacctttttctcggtcccctctttctcgccaaacaattttttttttttttctttttttttttttttttttcacattgtaaaatatagtttacttcaaaagatgatcctgaagatcccatcacagagtgtttaagggatgattataaacttttagcccttaagagagaatatatatactcaactgagtactgtctttcaaagcagtccctgtcagtttgtccattgattccatagcagctctcactgcccaccctgcttgagaagcctcttggagttgcctagagagtctatagcactcatctgaaggccctccatgagaacaactcttctcttccacatagatatttttgcatcagcccaaagctatttggacacaagtttggtgaacacggtaagaaaaaaacaaaccaagcaacaaaaacaaaaagcaggcagtgctgtgttagactgaaagtaaaagataaaaactctaagaacctatgaagcgccagggcagtgctggttgctttcacccatatggtctcctttggtgttctgctggtgcttatgaagcagtatccctactgacaatgaccctagcttaagagggctgagaactgctgaaagtgaagctgtttataaatggtacagtcaggaccgacagacacatgggtgtggtatgactgcaaagtacctgtggaattcagatgggattaccatccccactataaagggcaatatgatctgttgcaggagggtttatagggtacttagttacacaggtcacactgatccccttttcctctttttttctatgcaagtatctatttgtctatatgtctgtctaccttggtaggttgggctccttgaagaagggttatgttttcttcatctccatatccccagtagctggccaatgcccagtatacaccaggggctcagtcgctgtttgtcttattttcttgttgactctactctgacttaggacatatcactttcctctcttgaccttcacattcagatgtgttaataaaagtggataaagaccactctagctttaaaacaccctccaatatagagagaactctgaaaccagaagcagaagctgaggaatggtgaatagagcattttccctcacacgatgggtatcagggtggtttcttgtcctttcaatgcctctgcagaacttgaccctagtttttcaaattggactcaagaatgatcttagtgttggtggttttgtggttttctttgagactttgttattgacagaacagcttctggaaatctgtaatcccagctactccagaggctgaggcaggagatcacttgaacctgggagagggaggttgcagtgagctgagaacacatcattgtactccagcctgggcaacagagcaagactccatctttttcaccgggagtatgggggcttctttggccaaaccgtgcgcgtgcaggctccatgtgctgggcagcagctgtccggccacagcctgtcggttgcatcctgctcctctacagaggtttctgtgctctcaagacagtctcttccgtgacgagcaggcgcttagggctacctgtaccttcagacattatggtgtgtttggccatgtcatttgtcataggtgtaaaaaccacaaccgagagcccgaagctgctgggatgagcacctgccgcggaactgcattctcgcgctccttcctgctctttccaagaagccaggcgcggccggccagcatcccgctctcccggaccccgcagtcagtgtgggcagcaggcccagagtggtgcgagccgacggcggcgttagaaaggcggcgtcccgacgaacagagtgactcggcctcggctccccttcaaagcgccatcttatcgctgcttccctcaggagcaggcgagctcttccccaggacctgcttcgcggcttcccttcgcccgagaaccaccgggcggaggcggcggcctctctggccctgccgggaacagggcgcaggggaggggagcggcggccgaccggcctgaggcgggcgaacggcctctggcctccaggcgctgcctgctccggctcagaagcctcccggatcccgtcccggcccaactccgggcctccgcctccgccgccgcctccgggagccccgagccgcgtcccgccggcgccgcctcttccgcc

SEQ ID NO: 306978 - DNA, 2056 bp, Homo sapiens
atttgttcgttcttctgttttcctctttttgttcgttctttttgtttcttcttgctgtcgcgtgtctgcttctcgtcctgttcttctcctgcgtctgctcgggcttattttataatccttgtctctcctttgtccctccggttgtgtatactgtcccgctgtttgttctctcccgtggttcccttctttcgagattttggtttctcacaatcctgctcttgtgttttctctctcccccgcttttttttatttgtgtggatattcccctccgttatttgtgtgccgcggtgcttctcctgggtatctctttttgtctactgttctaccttgacccttgtggtgccccctcgtcgtcactactcttgttttctataaacctttttctcggtcccctctttctcgccaaacaattttttttttttttctttttttttttttttttttcacattgtaaaatatagtttacttcaaaagatgatcctgaagatcccatcacagagtgtttaagggatgattataaacttttagcccttaagagagaatatatatactcaactgagtactgtctttcaaagcagtccctgtcagtttgtccattgattccatagcagctctcactgcccaccctgcttgagaagcctcttggagttgcctagagagtctatagcactcatctgaaggccctccatgagaacaactcttctcttccacatagatatttttgcatcagcccaaagctatttggacacaagtttggtgaacacggtaagaaaaaaacaaaccaagcaacaaaaacaaaaagcaggcagtgctgtgttagactgaaagtaaaagataaaaactctaagaacctatgaagcgccagggcagtgctggttgctttcacccatatggtctcctttggtgttctgctggtgcttatgaagcagtatccctactgacaatgaccctagcttaagagggctgagaactgctgaaagtgaagctgtttataaatggtacagtcaggaccgacagacacatgggtgtggtatgactgcaaagtacctgtggaattcagatgggattaccatccccactataaagggcaatatgatctgttgcaggagggtttatagggtacttagttacacaggtcacactgatccccttttcctctttttttctatgcaagtatctatttgtctatatgtctgtctaccttggtaggttgggctccttgaagaagggttatgttttcttcatctccatatccccagtagctggccaatgcccagtatacaccaggggctcagtcgctgtttgtcttattttcttgttgactctactctgacttaggacatatcactttcctctcttgaccttcacattcagatgtgttaataaaagtggataaagaccactctagctttaaaacaccctccaatatagagagaactctgaaaccagaagcagaagctgaggaatggtgaatagagcattttccctcacacgatgggtatcagggtggtttcttgtcctttcaatgcctctgcagaacttgaccctagtttttcaaattggactcaagaatgatcttagtgttggtggttttgtggttttctttgagactttgttattgacagaacagcttctggaaatctgtaatcccagctactccagaggctgaggcaggagatcacttgaacctgggagagggaggttgcagtgagctgagaacacatcattgtactccagcctgggcaacagagcaagactccatctttttcaccgggagtatgggggcttctttggccaaaccgtgcgcgtgcaggctccatgtgctgggcagcagctgtccggccacagcctgtcggttgcatcctgctcctctacagaggtttctgccgcggaactgcattctcgcgctccttcctgctctttccaagaagccaggcgctgcctgctccggctcagaagcctcccggatcccgtcccggcccaactccgggcctccgcctccgccgccgcctccgggagccccgagccgcgtcccgccggcgccgcctcttccgcc

SEQ ID NO: 306979 - DNA, 2669 bp, Homo sapiens
atttgttcgttcttctgttttcctctttttgttcgttctttttgtttcttcttgctgtcgcgtgtctgcttctcgtcctgttcttctcctgcgtctgctcgggcttattttataatccttgtctctcctttgtccctccggttgtgtatactgtcccgctgtttgttctctcccgtggttcccttctttcgagattttggtttctcacaatcctgctcttgtgttttctctctcccccgcttttttttatttgtgtggatattcccctccgttatttgtgtgccgcggtgcttctcctgggtatctctttttgtctactgttctaccttgacccttgtggtgccccctcgtcgtcactactcttgttttctataaacctttttctcggtcccctctttctcgccaaacaattttttttttttttctttttttttttttttttttcacattgtaaaatatagtttacttcaaaagatgatcctgaagatcccatcacagagtgtttaagggatgattataaacttttagcccttaagagagaatatatatactcaactgagtactgtctttcaaagcagtccctgtcagtttgtccattgattccatagcagctctcactgcccaccctgcttgagaagcctcttggagttgcctagagagtctatagcactcatctgaaggccctccatgagaacaactcttctcttccacatagatatttttgcatcagcccaaagctatttggacacaagtttggtgaacacggtaagaaaaaaacaaaccaagcaacaaaaacaaaaagcaggcagtgctgtgttagactgaaagtaaaagataaaaactctaagaacctatgaagcgccagggcagtgctggttgctttcacccatatggtctcctttggtgttctgctggtgcttatgaagcagtatccctactgacaatgaccctagcttaagagggctgagaactgctgaaagtgaagctgtttataaatggtacagtcaggaccgacagacacatgggtgtggtatgactgcaaagtacctgtggaattcagatgggattaccatccccactataaagggcaatatgatctgttgcaggagggtttatagggtacttagttacacaggtcacactgatccccttttcctctttttttctatgcaagtatctatttgtctatatgtctgtctaccttggtaggttgggctccttgaagaagggttatgttttcttcatctccatatccccagtagctggccaatgcccagtatacaccaggggctcagtcgctgtttgtcttattttcttgttgactctactctgacttaggacatatcactttcctctcttgaccttcacattcagatgtgttaataaaagtggataaagaccactctagctttaaaacaccctccaatatagagagaactctgaaaccagaagcagaagctgaggaatggtgaatagagcattttccctcacacgatgggtatcagggtggtttcttgtcctttcaatgcctctgcagaacttgaccctagtttttcaaattggactcaagaatgatcttagtgttggtggttttgtggttttctttgagactttgttattgacagaacagcttctggaaatctgtaatcccagctactccagaggctgaggcaggagatcacttgaacctgggagagggaggttgcagtgagctgagaacacatcattgtactccagcctgggcaacagagcaagactccatctttttcaccgggagtatgggggcttctttggccaaaccgtgcgcgtgcaggctccatgtgctgggcagcagctgtccggccacagcctgtcggttgcatcctgctcctctacagaggtttcttcaactttgacaaaatactcccttttctaatttagcctgttctttcccagcaacaggttcatcttggaagcaggcaggatacagagtaatagagggggtttcgccagagcccttgggggctgcaaatatcagtgctgctgccgccgcccttgccaatgttgttagcccggtgacagcgagacgtgtctaagggccagtgccctggcctctacttcagaacgcagtgccctgtccgtgttcctcttagtacagggtgtttagagaatctttctatggctttttgtgttagatttcaaagacccgtgcactttgacaggatgggattttgtcagttctgtgacttcacgtccgtgtgaaagaggtctttaaggcagttcggttttgtagatcccatgcgaaaggagtcgctcaaaatcagggggcgaactacgcgggcgtgaactcgcaggatttatttttcgggtgcacagtaagtattcagtgaccttcagcggtgccctgacgggtgggtaatcagagctctatatcaccggcctcctctggccctttggcagagggcttcgcagctggcactgggccagaggagaacttcaggacccagcagtgactgtgaagataagcacatccatgatcctggacttcacgttctgattgcttgcttttttcattggttttcttgaaaacaattttgggggcctttttgttgtcttagctcttgacactcggtcttccatcttgtcatttgacatttccttgaaactgctggagctgaaagtttgtgaaa

SEQ ID NO: 306980 - DNA, 2042 bp, Homo sapiens
atttgttcgttcttctgttttcctctttttgttcgttctttttgtttcttcttgctgtcgcgtgtctgcttctcgtcctgttcttctcctgcgtctgctcgggcttattttataatccttgtctctcctttgtccctccggttgtgtatactgtcccgctgtttgttctctcccgtggttcccttctttcgagattttggtttctcacaatcctgctcttgtgttttctctctcccccgcttttttttatttgtgtggatattcccctccgttatttgtgtgccgcggtgcttctcctgggtatctctttttgtctactgttctaccttgacccttgtggtgccccctcgtcgtcactactcttgttttctataaacctttttctcggtcccctctttctcgccaaacaattttttttttttttctttttttttttttttttttcacattgtaaaatatagtttacttcaaaagatgatcctgaagatcccatcacagagtgtttaagggatgattataaacttttagcccttaagagagaatatatatactcaactgagtactgtctttcaaagcagtccctgtcagtttgtccattgattccatagcagctctcactgcccaccctgcttgagaagcctcttggagttgcctagagagtctatagcactcatctgaaggccctccatgagaacaactcttctcttccacatagatatttttgcatcagcccaaagctatttggacacaagtttggtgaacacggtaagaaaaaaacaaaccaagcaacaaaaacaaaaagcaggcagtgctgtgttagactgaaagtaaaagataaaaactctaagaacctatgaagcgccagggcagtgctggttgctttcacccatatggtctcctttggtgttctgctggtgcttatgaagcagtatccctactgacaatgaccctagcttaagagggctgagaactgctgaaagtgaagctgtttataaatggtacagtcaggaccgacagacacatgggtgtggtatgactgcaaagtacctgtggaattcagatgggattaccatccccactataaagggcaatatgatctgttgcaggagggtttatagggtacttagttacacaggtcacactgatccccttttcctctttttttctatgcaagtatctatttgtctatatgtctgtctaccttggtaggttgggctccttgaagaagggttatgttttcttcatctccatatccccagtagctggccaatgcccagtatacaccaggggctcagtcgctgtttgtcttattttcttgttgactctactctgacttaggacatatcactttcctctcttgaccttcacattcagatgtgttaataaaagtggataaagaccactctagctttaaaacaccctccaatatagagagaactctgaaaccagaagcagaagctgaggaatggtgaatagagcattttccctcacacgatgggtatcagggtggtttcttgtcctttcaatgcctctgcagaacttgaccctagtttttcaaattggactcaagaatgatcttagtgttggtggttttgtggttttctttgagactttgttattgacagaacagcttctggaaatcccagctactccagaggctgagattacaggtgcccgccacatagcccggctaattttttgtatttttagtagatacggggtttcaccatgttagccaggatggtctcaatctcttcacctcgtgatctgcccgcctcggcctcccaaagtgctgcgattacaggcgtgagccactgcgcccggcccttttttttttttttaaactaatatttatcaaggaggcaccagctgccaggcagtgaagagcttccaaacagcaactcattggctgcccagaagcaccctgtggcgcagagtcctttcttaggccacctttgggcccagaaaactaaagtgacttgccaagtccacacagccagtatgtgctaagccctctgacttgagagaccgagagcgtcact

SEQ ID NO: 306981 - DNA, 1675 bp, Homo sapiens
atttgttcgttcttctgttttcctctttttgttcgttctttttgtttcttcttgctgtcgcgtgtctgcttctcgtcctgttcttctcctgcgtctgctcgggcttattttataatccttgtctctcctttgtccctccggttgtgtatactgtcccgctgtttgttctctcccgtggttcccttctttcgagattttggtttctcacaatcctgctcttgtgttttctctctcccccgcttttttttatttgtgtggatattcccctccgttatttgtgtgccgcggtgcttctcctgggtatctctttttgtctactgttctaccttgacccttgtggtgccccctcgtcgtcactactcttgttttctataaacctttttctcggtcccctctttctcgccaaacaattttttttttttttctttttttttttttttttttcacattgtaaaatatagtttacttcaaaagatgatcctgaagatcccatcacagagtgtttaagggatgattataaacttttagcccttaagagagaatatatatactcaactgagtactgtctttcaaagcagtccctgtcagtttgtccattgattccatagcagctctcactgcccaccctgcttgagaagcctcttggagttgcctagagagtctatagcactcatctgaaggccctccatgagaacaactcttctcttccacatagatatttttgcatcagcccaaagctatttggacacaagtttggtgaacacggtaagaaaaaaacaaaccaagcaacaaaaacaaaaagcaggcagtgctgtgttagactgaaagtaaaagataaaaactctaagaacctatgaagcgccagggcagtgctggttgctttcacccatatggtctcctttggtgttctgctggtgcttatgaagcagtatccctactgacaatgaccctagcttaagagggctgagaactgctgaaagtgaagctgtttataaatggtacagtcaggaccgacagacacatgggtgtggtatgactgcaaagtacctgtggaattcagatgggattaccatccccactataaagggcaatatgatctgttgcaggagggtttatagggtacttagttacacaggtcacactgatccccttttcctctttttttctatgcaagtatctatttgtctatatgtctgtctaccttggtaggttgggctccttgaagaagggttatgttttcttcatctccatatccccagtagctggccaatgcccagtatacaccaggggctcagtcgctgtttgtcttattttcttgttgactctactctgacttaggacatatcactttcctctcttgaccttcacattcagatgtgttaataaaagtggataaagaccactctagctttaaaacaccctccaatatagagagaactctgaaaccagaagcagaagctgaggaatggtgaatagagcattttccctcacacgatgggtatcagggtggtttcttgtcctttcaatgcctctgcagaacttgaccctagtttttcaaattggactcaagaatgatcttagtgttggtggttttgtggttttctttgagactttgttattgacagaacagcttctggaaatctgatgtatcgttagggatcctctagatcacccc

SEQ ID NO: 306982 - DNA, 568 bp, Homo sapiens
ttctgatttcaaagtacatgttggaaacattaacaaaaacatcaaaatgatagaagtatacctgcttctactaaattcttgatgggaaagttctcaagaacaagcaattgtttccaaacaatgtactttgaaatcagaatcacttcttatcgttttcatatacttctgatgctcttcatcacattagtgatcagaaatgaggtgtaattccccaacccctgcccgcaagagctaagtaggatcttactgtaagttgaagggagttttgccctaactcatggattgtgcaagaatgaactgctgttgggtttgattgactgtcgatggattgtggtgtggtgtatctgaaggctattgaatgcaacttacaatgcttaataaaaatctttattcttttaggtataaaaaaaaaaaaaaaaaaaaaaaaaaaaagaagaaagcagaaaagaagcagaaaaagcaaagaggaaaaagaaaaagaaaaagagcagaaagaatgaaacaggaagaaacagagaaggaaagaaaaggaggcaagcagaagaacaagaacaagaagacacaatgt

SEQ ID NO: 306983 - DNA, 534 bp, Homo sapiens
acttctgatgctcttcatcacattagtgatcagaaatgaggtgtaattccccaacccctgcccgcaagagctaagtaggatcttactgtaagttgaagggagttttgccctaactcatggattgtgcaagaatgaactgctgttgggtttgattgactgtcgatggattgtggtgtggtgtatctgaaggctattgaatgcaacttacaatgcttaataaaaatctttattcttttaggtataaagtatggcgtggcttttaaattcacttgtaaaagctaattttatagaggtttaattcaaatcgaaacaactactgaaaagatcagaaaaccaaagttgaaaaatattttaccttttcaaagtaattccaggtttccggcttagagggacattaatatatgattaatttgtttgatagctcagtttcaagcaaccaaggggataaaaaaattctgtttgataaagcagacttacagaagaggtttttttaagccctgaggaagcaataaatttgactccaccacgttttaa

SEQ ID NO: 306984 - DNA, 364 bp, Homo sapiens
  misc_feature (23)..(23): n is a, c, g, or t
  misc_feature (32)..(32): n is a, c, g, or t
gaggcagtgcacggtgctgctgnggcgctctngaggatcccgtatctctaacattatgtcagtcattcatctgcatgtgaacatcacccacgaaattatagagttcagcttcatctagcatttgttatagtacataagaatatatagtgcagtattctaatgttacattagatctcaaataatcatggctgcagtcaagaggatagcacacaatatggtactttaaattatttcccattgaaaagcaaaaattaatgactaacagatattaaagttaaatttctgaatagaaagaacccaaggcttgtcattttaatttttattgttaatgttagagatacgggttacggggctcgaatccgta

SEQ ID NO: 306985 - DNA, 519 bp, Homo sapiens
ctgtatctaatttaaaacttaaaaaccaaaaaaatttttcccaaaatacagttagtacttgtaaggaggccatgagtaggcgatgcatataatttagtgctggaaaaataattccatatatgctttaattgaaaggatattgagcttatgacccttgcatataaaagacaacattataaactccattacatcttctgtatctctaacattatgtcagtcattcatctgcatgtgaacatcacccacgaaattatagagttcagcttcatctagcatttgttatagtacataagaatatatagtgcagtattctaatgttacattagatctcaaataatcatggctgcagtcaagaggatagcacacaatatggtactttaaattatttcccattgaaaagcaaaaattaatgactaacagatattaaagttaaatttctgaatagaaagaacccaaggcttgtcattttaatttttattgttaatgttagagatacgggttacggggctcgaatccgta

SEQ ID NO: 306986 - DNA, 6320 bp, Homo sapiens
  misc_feature (6308)..(6310): n is a, c, g, or t
  misc_feature (6312)..(6320): n is a, c, g, or t
cattgtttgaatttgaaaacggtaacatcgcagtgctgctcgcgggtctggctagtcaggcgaagtttgcagaatggaatctaattttaatcaagagggagtacctcgaccatcttatgtttttagtgctgacccaattgcaaggccttcagaaataaatttcgatggcattaagcttgatctgtctcatgaattttccttagttgctccaaatactgaggcaaacagtttcgaatctaaagattatctccaggtttgtcttcgaataagaccatttacacagtcagaaaaagaacttgagtctgagggctgtgtgcatattctggattcacagactgttgtgctgaaagagcctcaatgcatccttggtcggttaagtgaaaaaagctcagggcagatggcacagaaattcagtttttccaaggtttttggcccagcaactacacagaaggaattctttcagggttgcattatgcaaccagtaaaagacctcttgaaaggacagagtcgtctgatttttacttacgggctaaccaattcaggaaaaacatatacatttcaagggacagaagaaaatattggcattctgcctcgaactttgaatgtattatttgatagtcttcaagaaagactgtatacaaagatgaaccttaaaccacatagatccagagaatacttaaggttatcatcagaacaagagaaagaagaaattgctagcaaaagtgcattgcttcggcaaattaaagaggttactgtgcataatgatagtgatgatactctttatggaagtttaactaactctttgaatatctcagagtttgaagaatccataaaagattatgaacaagccaacttgaatatggctaatagtataaaattttctgtgtgggtttctttctttgaaatttacaatgaatatatttatgacttatttgttcctgtatcatctaaattccaaaagagaaagatgctgcgcctttcccaagacgtaaagggctattcttttataaaagatctacaatggattcaagtatctgattccaaagaagcctatagacttttaaaactaggaataaagcaccagagtgttgccttcacaaaattgaataatgcttccagtagaagtcacagcatattcactgttaaaatattacagattgaagattctgaaatgtctcgtgtaattcgagtcagtgaattatctttatgtgatcttgctggttcagaacgaactatgaagacacagaatgaaggtgaaaggttaagagagactgggaatatcaacacttctttattgactctgggaaagtgtattaacgtcttgaagaatagtgaaaagtcaaagtttcaacagcatgtgcctttccgggaaagtaaactgactcactattttcaaagtttttttaatggtaaagggaaaatttgtatgattgtcaatatcagccaatgttatttagcctatgatgaaacactcaatgtattgaagttctccgccattgcacaaaaagtttgtgtcccagacactttaaattcctctcaagagaaattatttggacctgtcaaatcttctcaagatgtatcactagacagtaattcaaacagtaaaatattaaatgtaaaaagagccaccatttcatgggaaaatagtctagaagatttgatggaagacgaggatttggttgaggagctagaaaacgctgaagaaactcaaaatgtggaaactaaacttcttgatgaagatctagataaaacattagaggaaaataaggctttcattagccacgaggagaaaagaaaactgttggacttaatagaagacttgaaaaaaaaactgataaatgaaaaaaaggaaaaattaaccttggaatttaaaattcgagaagaagttacacaggagtttactcagtattgggctcaacgggaagctgactttaaggagactctgcttcaagaacgagagatattagaagaaaatgctgaacgtcgtttggctatcttcaaggatttggttggtaaatgtgacactcgagaagaagcagcgaaagacatttgtgccacaaaagttgaaactgaagaagctactgcttgtttagaactaaagtttaatcaaattaaagctgaattagctaaaaccaaaggagaattaatcaaaaccaaagaagagttaaaaaagagagaaaatgaatcagattcattgattcaagagcttgagacatctaataagaaaataattacacagaatcaaagaattaaagaattgataaatataattgatcaaaaagaagatactatcaacgaatttcagaacctaaagtctcatatggaaaacacatttaaatgcaatgacaaggctgatacatcttctttaataataaacaataaattgatttgtaatgaaacagttgaagtacctaaggacagcaaatctaaaatctgttcagaaagaaaaagagtaaatgaaaatgaacttcagcaagatgaaccaccagcaaagaaagggtctatccatgttagttcagctatcactgaagaccaaaagaaaagtgaagaagtgcgaccgaacattgcagaaattgaagacatcagagttttacaagaaaataatgaaggactgagagcatttttactcactattgagaatgaacttaaaaatgaaaaggaagaaaaagcagaattaaataaacagattgttcattttcagcaggaactttctctttctgaaaaaaagaatttaactttaagtaaagaggtccaacaaattcagtcaaattatgatattgcaattgctgaattacatgtgcagaaaagtaaaaatcaagaacaggaggaaaagatcatgaaattgtcaaatgagatagaaactgctacaagaagcattacaaataatgtttcacaaataaaattaatgcacacgaaaatagacgaactacgtactcttgattcagtttctcagatttcaaacatagatttgctcaatctcagggatctgtcaaatggttctgaggaggataatttgccaaatacacagttagaccttttaggtaatgattatttggtaagtaagcaagttaaagaatatcgaattcaagaacccaatagggaaaattctttccactctagtattgaagctatttgggaagaatgtaaagagattgtgaaggcctcttccaaaaaaagtcatcagattgaggaactggaacaacaaattgaaaaattgcaggcagaagtaaaaggctataaggatgaaaacaatagactaaaggagaaggagcataaaaaccaagatgacctactaaaagaaaaagaaactcttatacagcagctgaaagaagaattgcaagaaaaaaatgttactcttgatgttcaaatacagcatgtagttgaaggaaagagagcgctttcagaacttacacaaggtgttacttgctataaggcaaaaataaaggaacttgaaacaattttagagactcagaaagttgaacgtagtcattcagccaagttagaacaagacattttggaaaaggaatctatcatcttaaagctagaaagaaatttgaaggaatttcaagaacatcttcaggattctgtcaaaaacaccaaagatttaaatgtaaaggaactcaagctgaaagaagaaatcacacagttaacaaataatttgcaagatatgaaacatttacttcaattaaaagaagaagaagaagaaaccaacaggcaagaaacagaaaaattgaaagaggaactctctgcaagctctgctcgtacccagaatctgaaagcagatcttcagaggaaggaagaagattatgctgacctgaaagagaaactgactgatgccaaaaagcagattaagcaagtacagaaagaggtatctgtaatgcgtgatgaggataaattactgaggattaaaattaatgaactggagaaaaagaaaaaccagtgttctcaggaattagatatgaaacagcgaaccattcagcaactcaaggagcagttaaataatcagaaagtggaagaagctatacaacagtatgagagagcatgcaaagatctaaatgttaaagagaaaataattgaagacatgcgaatgacactagaagaacaggaacaaactcaggtagaacaggatcaagtgcttgaggctaaattagaggaagttgaaaggctggccacagaattggaaaaatggaaggaaaaatgcaatgatttggaaaccaaaaacaatcaaaggtcaaataaagaacatgagaacaacacagatgtgcttggaaagctcactaatcttcaagatgagttacaggagtctgaacagaaatataatgctgatagaaagaaatggttagaagaaaaaatgatgcttatcactcaagcgaaagaagcagagaatatacgaaataaagagatgaaaaaatatgctgaggacagggagcgtttttttaagcaacagaatgaaatggaaatactgacagcccagctgacagagaaagatagtgaccttcaaaagtggcgagaagaacgagatcaactggttgcagctttagaaatacagctaaaagcactgatatccagtaatgtacagaaagataatgaaattgaacaactaaaaaggatcatatcagagacttctaaaatagaaacacaaatcatggatatcaagcccaaacgtattagttcagcagatcctgacaaacttcaaactgaacctctatcgacaagttttgaaatttccagaaataaaatagaggatggatctgtagtccttgactcttgtgaagtgtcaacagaaaatgatcaaagcactcgatttccaaaacctgagttagagattcaatttacacctttacagccaaacaaaatggcagtgaaacaccctggttgtaccacaccagtgacagttaagattcccaaggctcggaagaggaagagtaatgaaatggaggaggacttggtgaaatgtgaaaataagaagaatgctacacccagaactaatttgaaatttcctatttcagatgatagaaattcttctgtcaaaaaggaacaaaaggttgccatacgtccatcatctaagaaaacatattctttacggagtcaggcatccataattggtgtaaacctggccactaagaaaaaagaaggaacactacagaaatttggagacttcttacaacattctccctcaattcttcaatcaaaagcaaagaagataattgaaacaatgagctcttcaaagctctcaaatgtagaagcaagtaaagaaaatgtgtctcaaccaaaacgagccaaacggaaattatacacaagtgaaatttcatctcctattgatatatcaggccaagtgattttaatggaccagaaaatgaaggagagtgatcaccagattatcaaacgacgacttcgaacaaaaacagccaaataaatcacttatggaaatgtttaatataaattttatagtcatagtcattggaacttgcatcctgtattgtaaatataaatgtatatattatgcattaaatcactctgcatatagattgctgttttatacatagtataattttaattcaataaatgagtcaaaatttgtatatttttataaggcttttttataatagcttctttcaaactgtatttccctattatctcagacattggatcagtgaagatcctaggaaagaggctgttattctcatttattttgctatacaggatgtaataggtcaggtatttggtttacttatatttaacaatgtcttatgaattttttttactttatctgttatacaactgattttacatatctgtttggattatagctaggatttggagaataagtgtgtacagatcacaaaacatgtatatacattatttagaaaagatctcaagtctttaattagaatgtctcacttattttgtaaacattttgtgggtacatagtacatgtatatatttacggggtatgtgagatgttttgacacaggcatgcaatgtgaaatacgtgtatcatggagaatgaggtatccatcccctcaagcatttttcctttgaattacagataatccaattacattctttagatcatttaaaaatatacaagtaagttattattgattatagtcactctattgtgctatcagatagtagatcattctttttatcttatttgtttttgtacccattaaccatccccacctccccctgcaaccgtcagtacccttaccagccactggtaaccattcttctactctgtatgcccatgaggtcaattgattttatttttagatcccataaataaatgagaacatgcagtcttnnncnnnnnnnnn

SEQ ID NO: 306987 - DNA, 6440 bp, Homo sapiens
  misc_feature (6428)..(6430): n is a, c, g, or t
  misc_feature (6432)..(6440): n is a, c, g, or t
cattgtttgaatttgaaaacggtaacatcgcagtgctgctcgcgggtctggctagtcaggcgaagtttgcagaatggaatctaattttaatcaagagggagtacctcgaccatcttatgtttttagtgctgacccaattgcaaggccttcagaaataaatttcgatggcattaagcttgatctgtctcatgaattttccttagttgctccaaatactgaggcaaacagtttcgaatctaaagattatctccaggtttgtcttcgaataagaccatttacacagtcagaaaaagaacttgagtctgagggctgtgtgcatattctggattcacagactgttgtgctgaaagagcctcaatgcatccttggtcggttaagtgaaaaaagctcagggcagatggcacagaaattcagtttttccaaggtttttggcccagcaactacacagaaggaattctttcagggttgcattatgcaaccagtaaaagacctcttgaaaggacagagtcgtctgatttttacttacgggctaaccaattcaggaaaaacatatacatttcaagggacagaagaaaatattggcattctgcctcgaactttgaatgtattatttgatagtcttcaagaaagactgtatacaaagatgaaccttaaaccacatagatccagagaatacttaaggttatcatcagaacaagagaaagaagaaattgctagcaaaagtgcattgcttcggcaaattaaagaggttactgtgcataatgatagtgatgatactctttatggaagtttaactaactctttgaatatctcagagtttgaagaatccataaaagattatgaacaagccaacttgaatatggctaatagtataaaattttctgtgtgggtttctttctttgaaatttacaatgaatatatttatgacttatttgttcctgtatcatctaaattccaaaagagaaagatgctgcgcctttcccaagacgtaaagggctattcttttataaaagatctacaatggattcaagtatctgattccaaagaagcctatagacttttaaaactaggaataaagcaccagagtgttgccttcacaaaattgaataatgcttccagtagaagtcacagcatattcactgttaaaatattacagattgaagattctgaaatgtctcgtgtaattcgagtcagtgaattatctttatgtgatcttgctggttcagaacgaactatgaagacacagaatgaaggtgaaaggttaagagagactgggaatatcaacacttctttattgactctgggaaagtgtattaacgtcttgaagaatagtgaaaagtcaaagtttcaacagcatgtgcctttccgggaaagtaaactgactcactattttcaaagtttttttaatggtaaagggaaaatttgtatgattgtcaatatcagccaatgttatttagcctatgatgaaacactcaatgtattgaagttctccgccattgcacaaaaagtttgtgtcccagacactttaaattcctctcaagagaaattatttggacctgtcaaatcttctcaagatgtatcactagacagtaattcaaacagtaaaatattaaatgtaaaaagagccaccatttcatgggaaaatagtctagaagatttgatggaagacgaggatttggttgaggagctagaaaacgctgaagaaactcaaaatgtggaaactaaacttcttgatgaagatctagataaaacattagaggaaaataaggctttcattagccacgaggagaaaagaaaactgttggacttaatagaagacttgaaaaaaaaactgataaatgaaaaaaaggaaaaattaaccttggaatttaaaattcgagaagaagttacacaggagtttactcagtattgggctcaacgggaagctgactttaaggagactctgcttcaagaacgagagatattagaagaaaatgctgaacgtcgtttggctatcttcaaggatttggttggtaaatgtgacactcgagaagaagcagcgaaagacatttgtgccacaaaagttgaaactgaagaaacacataattatgtaggatttgaagatattattgattctcttcaagataatgttgctgatattaagaaacaggctgaaattgctcacttatatattgcatctcttcctgacccccaggaagctactgcttgtttagaactaaagtttaatcaaattaaagctgaattagctaaaaccaaaggagaattaatcaaaaccaaagaagagttaaaaaagagagaaaatgaatcagattcattgattcaagagcttgagacatctaataagaaaataattacacagaatcaaagaattaaagaattgataaatataattgatcaaaaagaagatactatcaacgaatttcagaacctaaagtctcatatggaaaacacatttaaatgcaatgacaaggctgatacatcttctttaataataaacaataaattgatttgtaatgaaacagttgaagtacctaaggacagcaaatctaaaatctgttcagaaagaaaaagagtaaatgaaaatgaacttcagcaagatgaaccaccagcaaagaaagggtctatccatgttagttcagctatcactgaagaccaaaagaaaagtgaagaagtgcgaccgaacattgcagaaattgaagacatcagagttttacaagaaaataatgaaggactgagagcatttttactcactattgagaatgaacttaaaaatgaaaaggaagaaaaagcagaattaaataaacagattgttcattttcagcaggaactttctctttctgaaaaaaagaatttaactttaagtaaagaggtccaacaaattcagtcaaattatgatattgcaattgctgaattacatgtgcagaaaagtaaaaatcaagaacaggaggaaaagatcatgaaattgtcaaatgagatagaaactgctacaagaagcattacaaataatgtttcacaaataaaattaatgcacacgaaaatagacgaactacgtactcttgattcagtttctcagatttcaaacatagatttgctcaatctcagggatctgtcaaatggttctgaggaggataatttgccaaatacacagttagaccttttaggtaatgattatttggtaagtaagcaagttaaagaatatcgaattcaagaacccaatagggaaaattctttccactctagtattgaagctatttgggaagaatgtaaagagattgtgaaggcctcttccaaaaaaagtcatcagattgaggaactggaacaacaaattgaaaaattgcaggcagaagtaaaaggctataaggatgaaaacaatagactaaaggagaaggagcataaaaaccaagatgacctactaaaagaaaaagaaactcttatacagcagctgaaagaagaattgcaagaaaaaaatgttactcttgatgttcaaatacagcatgtagttgaaggaaagagagcgctttcagaacttacacaaggtgttacttgctataaggcaaaaataaaggaacttgaaacaattttagagactcagaaagttgaacgtagtcattcagccaagttagaacaagacattttggaaaaggaatctatcatcttaaagctagaaagaaatttgaaggaatttcaagaacatcttcaggattctgtcaaaaacaccaaagatttaaatgtaaaggaactcaagctgaaagaagaaatcacacagttaacaaataatttgcaagatatgaaacatttacttcaattaaaagaagaagaagaagaaaccaacaggcaagaaacagaaaaattgaaagaggaactctctgcaagctctgctcgtacccagaatctgaaagcagatcttcagaggaaggaagaagattatgctgacctgaaagagaaactgactgatgccaaaaagcagattaagcaagtacagaaagaggtatctgtaatgcgtgatgaggataaattactgaggattaaaattaatgaactggagaaaaagaaaaaccagtgttctcaggaattagatatgaaacagcgaaccattcagcaactcaaggagcagttaaataatcagaaagtggaagaagctatacaacagtatgagagagcatgcaaagatctaaatgttaaagagaaaataattgaagacatgcgaatgacactagaagaacaggaacaaactcaggtagaacaggatcaagtgcttgaggctaaattagaggaagttgaaaggctggccacagaattggaaaaatggaaggaaaaatgcaatgatttggaaaccaaaaacaatcaaaggtcaaataaagaacatgagaacaacacagatgtgcttggaaagctcactaatcttcaagatgagttacaggagtctgaacagaaatataatgctgatagaaagaaatggttagaagaaaaaatgatgcttatcactcaagcgaaagaagcagagaatatacgaaataaagagatgaaaaaatatgctgaggacagggagcgtttttttaagcaacagaatgaaatggaaatactgacagcccagctgacagagaaagatagtgaccttcaaaagtggcgagaagaacgagatcaactggttgcagctttagaaatacagctaaaagcactgatatccagtaatgtacagaaagataatgaaattgaacaactaaaaaggatcatatcagagacttctaaaatagaaacacaaatcatggatatcaagcccaaacgtattagttcagcagatcctgacaaacttcaaactgaacctctatcgacaagttttgaaatttccagaaataaaatagaggatggatctgtagtccttgactcttgtgaagtgtcaacagaaaatgatcaaagcactcgatttccaaaacctgagttagagattcaatttacacctttacagccaaacaaaatggcagtgaaacaccctggttgtaccacaccagtgacagttaagattcccaaggctcggaagaggaagagtaatgaaatggaggaggacttggtgaaatgtgaaaataagaagaatgctacacccagaactaatttgaaatttcctatttcagatgatagaaattcttctgtcaaaaaggaacaaaaggttgccatacgtccatcatctaagaaaacatattctttacggagtcaggcatccataattggtgtaaacctggccactaagaaaaaagaaggaacactacagaaatttggagacttcttacaacattctccctcaattcttcaatcaaaagcaaagaagataattgaaacaatgagctcttcaaagctctcaaatgtagaagcaagtaaagaaaatgtgtctcaaccaaaacgagccaaacggaaattatacacaagtgaaatttcatctcctattgatatatcaggccaagtgattttaatggaccagaaaatgaaggagagtgatcaccagattatcaaacgacgacttcgaacaaaaacagccaaataaatcacttatggaaatgtttaatataaattttatagtcatagtcattggaacttgcatcctgtattgtaaatataaatgtatatattatgcattaaatcactctgcatatagattgctgttttatacatagtataattttaattcaataaatgagtcaaaatttgtatatttttataaggcttttttataatagcttctttcaaactgtatttccctattatctcagacattggatcagtgaagatcctaggaaagaggctgttattctcatttattttgctatacaggatgtaataggtcaggtatttggtttacttatatttaacaatgtcttatgaattttttttactttatctgttatacaactgattttacatatctgtttggattatagctaggatttggagaataagtgtgtacagatcacaaaacatgtatatacattatttagaaaagatctcaagtctttaattagaatgtctcacttattttgtaaacattttgtgggtacatagtacatgtatatatttacggggtatgtgagatgttttgacacaggcatgcaatgtgaaatacgtgtatcatggagaatgaggtatccatcccctcaagcatttttcctttgaattacagataatccaattacattctttagatcatttaaaaatatacaagtaagttattattgattatagtcactctattgtgctatcagatagtagatcattctttttatcttatttgtttttgtacccattaaccatccccacctccccctgcaaccgtcagtacccttaccagccactggtaaccattcttctactctgtatgcccatgaggtcaattgattttatttttagatcccataaataaatgagaacatgcagtcttnnncnnnnnnnnn

SEQ ID NO: 306988 - DNA, 4929 bp, Homo sapiens
  misc_feature (4917)..(4919): n is a, c, g, or t
  misc_feature (4921)..(4929): n is a, c, g, or t
tagcatttaccagagatctgatccttatgcttcccacctgtgaaatatggatgataccaagctcacagaaagttgtggattaaatgaagcaaatatggaactccccagagtagttcttgatagataataaatgcactaattaactttacttattttcttagtatagctaaacagtgagacgagttaccaaaggtctatttctaaaatgtggaaaggccaacctgatttttcagttaacaaatctttgcaaacatataattttcagtgagaacattatcactattaaaaaggacacagaattacaattgactaaatgtaaagttttattttttgaacagttggacggtatttctcttgggatatatttattcttttataagaattttatcatttacatgtaatagaaactgttggacttaatagaagacttgaaaaaaaaactgataaatgaaaaaaaggaaaaattaaccttggaatttaaaattcgagaagaagttacacaggagtttactcagtattgggctcaacgggaagctgactttaaggagactctgcttcaagaacgagagatattagaagaaaatgctgaacgtcgtttggctatcttcaaggatttggttggtaaatgtgacactcgagaagaagcagcgaaagacatttgtgccacaaaagttgaaactgaagaagctactgcttgtttagaactaaagtttaatcaaattaaagctgaattagctaaaaccaaaggagaattaatcaaaaccaaagaagagttaaaaaagagagaaaatgaatcagattcattgattcaagagcttgagacatctaataagaaaataattacacagaatcaaagaattaaagaattgataaatataattgatcaaaaagaagatactatcaacgaatttcagaacctaaagtctcatatggaaaacacatttaaatgcaatgacaaggctgatacatcttctttaataataaacaataaattgatttgtaatgaaacagttgaagtacctaaggacagcaaatctaaaatctgttcagaaagaaaaagagtaaatgaaaatgaacttcagcaagatgaaccaccagcaaagaaagggtctatccatgttagttcagctatcactgaagaccaaaagaaaagtgaagaagtgcgaccgaacattgcagaaattgaagacatcagagttttacaagaaaataatgaaggactgagagcatttttactcactattgagaatgaacttaaaaatgaaaaggaagaaaaagcagaattaaataaacagattgttcattttcagcaggaactttctctttctgaaaaaaagaatttaactttaagtaaagaggtccaacaaattcagtcaaattatgatattgcaattgctgaattacatgtgcagaaaagtaaaaatcaagaacaggaggaaaagatcatgaaattgtcaaatgagatagaaactgctacaagaagcattacaaataatgtttcacaaataaaattaatgcacacgaaaatagacgaactacgtactcttgattcagtttctcagatttcaaacatagatttgctcaatctcagggatctgtcaaatggttctgaggaggataatttgccaaatacacagttagaccttttaggtaatgattatttggtaagtaagcaagttaaagaatatcgaattcaagaacccaatagggaaaattctttccactctagtattgaagctatttgggaagaatgtaaagagattgtgaaggcctcttccaaaaaaagtcatcagattgaggaactggaacaacaaattgaaaaattgcaggcagaagtaaaaggctataaggatgaaaacaatagactaaaggagaaggagcataaaaaccaagatgacctactaaaagaaaaagaaactcttatacagcagctgaaagaagaattgcaagaaaaaaatgttactcttgatgttcaaatacagcatgtagttgaaggaaagagagcgctttcagaacttacacaaggtgttacttgctataaggcaaaaataaaggaacttgaaacaattttagagactcagaaagttgaacgtagtcattcagccaagttagaacaagacattttggaaaaggaatctatcatcttaaagctagaaagaaatttgaaggaatttcaagaacatcttcaggattctgtcaaaaacaccaaagatttaaatgtaaaggaactcaagctgaaagaagaaatcacacagttaacaaataatttgcaagatatgaaacatttacttcaattaaaagaagaagaagaagaaaccaacaggcaagaaacagaaaaattgaaagaggaactctctgcaagctctgctcgtacccagaatctgaaagcagatcttcagaggaaggaagaagattatgctgacctgaaagagaaactgactgatgccaaaaagcagattaagcaagtacagaaagaggtatctgtaatgcgtgatgaggataaattactgaggattaaaattaatgaactggagaaaaagaaaaaccagtgttctcaggaattagatatgaaacagcgaaccattcagcaactcaaggagcagttaaataatcagaaagtggaagaagctatacaacagtatgagagagcatgcaaagatctaaatgttaaagagaaaataattgaagacatgcgaatgacactagaagaacaggaacaaactcaggtagaacaggatcaagtgcttgaggctaaattagaggaagttgaaaggctggccacagaattggaaaaatggaaggaaaaatgcaatgatttggaaaccaaaaacaatcaaaggtcaaataaagaacatgagaacaacacagatgtgcttggaaagctcactaatcttcaagatgagttacaggagtctgaacagaaatataatgctgatagaaagaaatggttagaagaaaaaatgatgcttatcactcaagcgaaagaagcagagaatatacgaaataaagagatgaaaaaatatgctgaggacagggagcgtttttttaagcaacagaatgaaatggaaatactgacagcccagctgacagagaaagatagtgaccttcaaaagtggcgagaagaacgagatcaactggttgcagctttagaaatacagctaaaagcactgatatccagtaatgtacagaaagataatgaaattgaacaactaaaaaggatcatatcagagacttctaaaatagaaacacaaatcatggatatcaagcccaaacgtattagttcagcagatcctgacaaacttcaaactgaacctctatcgacaagttttgaaatttccagaaataaaatagaggatggatctgtagtccttgactcttgtgaagtgtcaacagaaaatgatcaaagcactcgatttccaaaacctgagttagagattcaatttacacctttacagccaaacaaaatggcagtgaaacaccctggttgtaccacaccagtgacagttaagattcccaaggctcggaagaggaagagtaatgaaatggaggaggacttggtgaaatgtgaaaataagaagaatgctacacccagaactaatttgaaatttcctatttcagatgatagaaattcttctgtcaaaaaggaacaaaaggttgccatacgtccatcatctaagaaaacatattctttacggagtcaggcatccataattggtgtaaacctggccactaagaaaaaagaaggaacactacagaaatttggagacttcttacaacattctccctcaattcttcaatcaaaagcaaagaagataattgaaacaatgagctcttcaaagctctcaaatgtagaagcaagtaaagaaaatgtgtctcaaccaaaacgagccaaacggaaattatacacaagtgaaatttcatctcctattgatatatcaggccaagtgattttaatggaccagaaaatgaaggagagtgatcaccagattatcaaacgacgacttcgaacaaaaacagccaaataaatcacttatggaaatgtttaatataaattttatagtcatagtcattggaacttgcatcctgtattgtaaatataaatgtatatattatgcattaaatcactctgcatatagattgctgttttatacatagtataattttaattcaataaatgagtcaaaatttgtatatttttataaggcttttttataatagcttctttcaaactgtatttccctattatctcagacattggatcagtgaagatcctaggaaagaggctgttattctcatttattttgctatacaggatgtaataggtcaggtatttggtttacttatatttaacaatgtcttatgaattttttttactttatctgttatacaactgattttacatatctgtttggattatagctaggatttggagaataagtgtgtacagatcacaaaacatgtatatacattatttagaaaagatctcaagtctttaattagaatgtctcacttattttgtaaacattttgtgggtacatagtacatgtatatatttacggggtatgtgagatgttttgacacaggcatgcaatgtgaaatacgtgtatcatggagaatgaggtatccatcccctcaagcatttttcctttgaattacagataatccaattacattctttagatcatttaaaaatatacaagtaagttattattgattatagtcactctattgtgctatcagatagtagatcattctttttatcttatttgtttttgtacccattaaccatccccacctccccctgcaaccgtcagtacccttaccagccactggtaaccattcttctactctgtatgcccatgaggtcaattgattttatttttagatcccataaataaatgagaacatgcagtcttnnncnnnnnnnnn

SEQ ID NO: 306989 - DNA, 2303 bp, Homo sapiens
cattgtttgaatttgaaaacggtaacatcgcagtgctgctcgcgggtctggctagtcaggcgaagtttgcagaatggaatctaattttaatcaagagggagtacctcgaccatcttatgtttttagtgctgacccaattgcaaggccttcagaaataaatttcgatggcattaagcttgatctgtctcatgaattttccttagttgctccaaatactgaggcaaacagtttcgaatctaaagattatctccaggtttgtcttcgaataagaccatttacacagtcagaaaaagaacttgagtctgagggctgtgtgcatattctggattcacagactgttgtgctgaaagagcctcaatgcatccttggtcggttaagtgaaaaaagctcagggcagatggcacagaaattcagtttttccaaggtttttggcccagcaactacacagaaggaattctttcagggttgcattatgcaaccagtaaaagacctcttgaaaggacagagtcgtctgatttttacttacgggctaaccaattcaggaaaaacatatacatttcaagggacagaagaaaatattggcattctgcctcgaactttgaatgtattatttgatagtcttcaagaaagactgtatacaaagatgaaccttaaaccacatagatccagagaatacttaaggttatcatcagaacaagagaaagaagaaattgctagcaaaagtgcattgcttcggcaaattaaagaggttactgtgcataatgatagtgatgatactctttatggaagtttaactaactctttgaatatctcagagtttgaagaatccataaaagattatgaacaagccaacttgaatatggctaatagtataaaattttctgtgtgggtttctttctttgaaatttacaatgaatatatttatgacttatttgttcctgtatcatctaaattccaaaagagaaagatgctgcgcctttcccaagacgtaaagggctattcttttataaaagatctacaatggattcaagtatctgattccaaagaagcctatagacttttaaaactaggaataaagcaccagagtgttgccttcacaaaattgaataatgcttccagtagaagtcacagcatattcactgttaaaatattacagattgaagattctgaaatgtctcgtgtaattcgagtcagtgaattatctttatgtgatcttgctggttcagaacgaactatgaagacacagaatgaaggtgaaaggttaagagagactgggaatatcaacacttctttattgactctgggaaagtgtattaacgtcttgaagaatagtgaaaagtcaaagtttcaacagcatgtgcctttccgggaaagtaaactgactcactattttcaaagtttttttaatggtaaagggaaaatttgtatgattgtcaatatcagccaatgttatttagcctatgatgaaacactcaatgtattgaagttctccgccattgcacaaaaagtttgtgtcccagacactttaaattcctctcaagagaaattatttggacctgtcaaatcttctcaagatgtatcactagacagtaattcaaacagtaaaatattaaatgtaaaaagagccaccatttcatgggaaaatagtctagaagatttgatggaagacgaggatttggttgaggagctagaaaacgctgaagaaactcaaaatgtggaaactaaacttcttgatgaagatctagataaaacattagaggaaaataaggctttcattagccacgaggagaaaagaaaactgttggacttaatagaagacttgaaaaaaaaactgataaatgaaaaaaaggaaaaattaaccttggaatttaaaattcgagaagaagttacacaggagtttactcagtattgggctcaacgggaagctgactttaaggagactctgcttcaagaacgagagatattagaagaaaatgctgaacgtcgtttggctatcttcaaggatttggttggtaaatgtgacactcgagaagaagcagcgaaagacatttgtgccacaaaagttgaaactgaagaaacacataattatgtaggatttgaagatattattgattctcttcaagataatgttgctgatattaagaaacaggctgaaattgctcacttatatattgcatctcttcctgacccccaggaagctactgcttgtttagaactaaagtttaatcaaattaaagctgaattagctaaaaccaaaggagaattaatcaaaaccaaagaagagttaaaaaagagagaaaatg

SEQ ID NO: 306990 - DNA, 837 bp, Homo sapiens
tagcatttaccagagatctgatccttatgcttcccacctgtgaaatatggatgataccaagctcacagaaagttgtggattaaatgaagcaaatatggaactccccagagtagttcttgatagataataaatgcactaattaactttacttattttcttagtatagctaaacagtgagacgagttaccaaaggtctatttctaaaatgtggaaaggccaacctgatttttcagttaacaaatctttgcaaacatataattttcagtgagaacattatcactattaaaaaggacacagaattacaattgactaaatgtaaagttttattttttgaacagttggacggtatttctcttgggatatatttattcttttataagaattttatcatttacatgtaatagaaactgttggacttaatagaagacttgaaaaaaaaactgataaatgaaaaaaaggaaaaattaaccttggaatttaaaattcgagaagaagttacacaggagtttactcagtattgggctcaacgggaagctgactttaaggagactctgcttcaagaacgagagatattagaagaaaatgctgaacgtcgtttggctatcttcaaggatttggttggtaaatgtgacactcgagaagaagcagcgaaagacatttgtgccacaaaagttgaaactgaagtatgttaattgaagtatttaaaaatatccagtgaggttttggtaccagggtttagtgtaccacatcaatgatgagaaacaccaagatagtttagaattaaaacaatgctttgtgtgtagctttattataattaggcatgtttttttagaagtg

SEQ ID NO: 306991 - DNA, 319 bp, Homo sapiens
ttttttaaaaactgtctaaattagatggtaccacatgtaaagggtgaaccctactgttaatattaggcatgtggtttttgctatttttaggaaacacataattatgtaggatttgaagatattattgattctcttcaagataatgttgctgatattaagaaacaggctgaaattgctcacttatatattgcatctcttcctgacccccaggaagctactgcttgtttagaactaaagtttaatcaaattaaagctgaattagctaaaaccaaaggagaattaatcaaaaccaaagaagagttaaaaaagagagaaaatg

SEQ ID NO: 306992 - DNA, 6342 bp, Homo sapiens
  misc_feature (6330)..(6332): n is a, c, g, or t
  misc_feature (6334)..(6342): n is a, c, g, or t
cattgtttgaatttgaaaacggtaacatcgcagtgctgctcgcgggtctggctagtcaggcgaagtttgcagaatggaatctaattttaatcaagagggagtacctcgaccatcttatgtttttagtgctgacccaattgcaaggccttcagaaataaatttcgatggcattaagcttgatctgtctcatgaattttccttagttgctccaaatactgaggcaaacagtttcgaatctaaagattatctccaggtttgtcttcgaataagaccatttacacagtcagaaaaagaacttgagtctgagggctgtgtgcatattctggattcacagactgttgtgctgaaagagcctcaatgcatccttggtcggttaagtgaaaaaagctcagggcagatggcacagaaattcagtttttccaaggtttttggcccagcaactacacagaaggaattctttcagggttgcattatgcaaccagtaaaagacctcttgaaaggacagagtcgtctgatttttacttacgggctaaccaattcaggaaaaacatatacatttcaagggacagaagaaaatattggcattctgcctcgaactttgaatgtattatttgatagtcttcaagaaagactgtatacaaagatgaaccttaaaccacatagatccagagaatacttaaggttatcatcagaacaagagaaagaagaaattgctagcaaaagtgcattgcttcggcaaattaaagaggttactgtgcataatgatagtgatgatactctttatggaagtttaactaactctttgaatatctcagagtttgaagaatccataaaagattatgaacaagccaacttgaatatggctaatagtataaaattttctgtgtgggtttctttctttgaaatttacaatgaatatatttatgacttatttgttcctgtatcatctaaattccaaaagagaaagatgctgcgcctttcccaagacgtaaagggctattcttttataaaagatctacaatggattcaagtatctgattccaaagaagcctatagacttttaaaactaggaataaagcaccagagtgttgccttcacaaaattgaataatgcttccagtagaagtcacagcatattcactgttaaaatattacagattgaagattctgaaatgtctcgtgtaattcgagtcagtgaattatctttatgtgatcttgctggttcagaacgaactatgaagacacagaatgaaggtgaaaggttaagagagactgggaatatcaacacttctttattgactctgggaaagtgtattaacgtcttgaagaatagtgaaaagtcaaagtttcaacagcatgtgcctttccgggaaagtaaactgactcactattttcaaagtttttttaatggtttgtgtcccagacactttaaattcctctcaagagaaattatttggacctgtcaaatcttctcaagatgtatcactagacagtaattcaaacagtaaaatattaaatgtaaaaagagccaccatttcatgggaaaatagtctagaagatttgatggaagacgaggatttggttgaggagctagaaaacgctgaagaaactcaaaatgtggaaactaaacttcttgatgaagatctagataaaacattagaggaaaataaggctttcattagccacgaggagaaaagaaaactgttggacttaatagaagacttgaaaaaaaaactgataaatgaaaaaaaggaaaaattaaccttggaatttaaaattcgagaagaagttacacaggagtttactcagtattgggctcaacgggaagctgactttaaggagactctgcttcaagaacgagagatattagaagaaaatgctgaacgtcgtttggctatcttcaaggatttggttggtaaatgtgacactcgagaagaagcagcgaaagacatttgtgccacaaaagttgaaactgaagaaacacataattatgtaggatttgaagatattattgattctcttcaagataatgttgctgatattaagaaacaggctgaaattgctcacttatatattgcatctcttcctgacccccaggaagctactgcttgtttagaactaaagtttaatcaaattaaagctgaattagctaaaaccaaaggagaattaatcaaaaccaaagaagagttaaaaaagagagaaaatgaatcagattcattgattcaagagcttgagacatctaataagaaaataattacacagaatcaaagaattaaagaattgataaatataattgatcaaaaagaagatactatcaacgaatttcagaacctaaagtctcatatggaaaacacatttaaatgcaatgacaaggctgatacatcttctttaataataaacaataaattgatttgtaatgaaacagttgaagtacctaaggacagcaaatctaaaatctgttcagaaagaaaaagagtaaatgaaaatgaacttcagcaagatgaaccaccagcaaagaaagggtctatccatgttagttcagctatcactgaagaccaaaagaaaagtgaagaagtgcgaccgaacattgcagaaattgaagacatcagagttttacaagaaaataatgaaggactgagagcatttttactcactattgagaatgaacttaaaaatgaaaaggaagaaaaagcagaattaaataaacagattgttcattttcagcaggaactttctctttctgaaaaaaagaatttaactttaagtaaagaggtccaacaaattcagtcaaattatgatattgcaattgctgaattacatgtgcagaaaagtaaaaatcaagaacaggaggaaaagatcatgaaattgtcaaatgagatagaaactgctacaagaagcattacaaataatgtttcacaaataaaattaatgcacacgaaaatagacgaactacgtactcttgattcagtttctcagatttcaaacatagatttgctcaatctcagggatctgtcaaatggttctgaggaggataatttgccaaatacacagttagaccttttaggtaatgattatttggtaagtaagcaagttaaagaatatcgaattcaagaacccaatagggaaaattctttccactctagtattgaagctatttgggaagaatgtaaagagattgtgaaggcctcttccaaaaaaagtcatcagattgaggaactggaacaacaaattgaaaaattgcaggcagaagtaaaaggctataaggatgaaaacaatagactaaaggagaaggagcataaaaaccaagatgacctactaaaagaaaaagaaactcttatacagcagctgaaagaagaattgcaagaaaaaaatgttactcttgatgttcaaatacagcatgtagttgaaggaaagagagcgctttcagaacttacacaaggtgttacttgctataaggcaaaaataaaggaacttgaaacaattttagagactcagaaagttgaacgtagtcattcagccaagttagaacaagacattttggaaaaggaatctatcatcttaaagctagaaagaaatttgaaggaatttcaagaacatcttcaggattctgtcaaaaacaccaaagatttaaatgtaaaggaactcaagctgaaagaagaaatcacacagttaacaaataatttgcaagatatgaaacatttacttcaattaaaagaagaagaagaagaaaccaacaggcaagaaacagaaaaattgaaagaggaactctctgcaagctctgctcgtacccagaatctgaaagcagatcttcagaggaaggaagaagattatgctgacctgaaagagaaactgactgatgccaaaaagcagattaagcaagtacagaaagaggtatctgtaatgcgtgatgaggataaattactgaggattaaaattaatgaactggagaaaaagaaaaaccagtgttctcaggaattagatatgaaacagcgaaccattcagcaactcaaggagcagttaaataatcagaaagtggaagaagctatacaacagtatgagagagcatgcaaagatctaaatgttaaagagaaaataattgaagacatgcgaatgacactagaagaacaggaacaaactcaggtagaacaggatcaagtgcttgaggctaaattagaggaagttgaaaggctggccacagaattggaaaaatggaaggaaaaatgcaatgatttggaaaccaaaaacaatcaaaggtcaaataaagaacatgagaacaacacagatgtgcttggaaagctcactaatcttcaagatgagttacaggagtctgaacagaaatataatgctgatagaaagaaatggttagaagaaaaaatgatgcttatcactcaagcgaaagaagcagagaatatacgaaataaagagatgaaaaaatatgctgaggacagggagcgtttttttaagcaacagaatgaaatggaaatactgacagcccagctgacagagaaagatagtgaccttcaaaagtggcgagaagaacgagatcaactggttgcagctttagaaatacagctaaaagcactgatatccagtaatgtacagaaagataatgaaattgaacaactaaaaaggatcatatcagagacttctaaaatagaaacacaaatcatggatatcaagcccaaacgtattagttcagcagatcctgacaaacttcaaactgaacctctatcgacaagttttgaaatttccagaaataaaatagaggatggatctgtagtccttgactcttgtgaagtgtcaacagaaaatgatcaaagcactcgatttccaaaacctgagttagagattcaatttacacctttacagccaaacaaaatggcagtgaaacaccctggttgtaccacaccagtgacagttaagattcccaaggctcggaagaggaagagtaatgaaatggaggaggacttggtgaaatgtgaaaataagaagaatgctacacccagaactaatttgaaatttcctatttcagatgatagaaattcttctgtcaaaaaggaacaaaaggttgccatacgtccatcatctaagaaaacatattctttacggagtcaggcatccataattggtgtaaacctggccactaagaaaaaagaaggaacactacagaaatttggagacttcttacaacattctccctcaattcttcaatcaaaagcaaagaagataattgaaacaatgagctcttcaaagctctcaaatgtagaagcaagtaaagaaaatgtgtctcaaccaaaacgagccaaacggaaattatacacaagtgaaatttcatctcctattgatatatcaggccaagtgattttaatggaccagaaaatgaaggagagtgatcaccagattatcaaacgacgacttcgaacaaaaacagccaaataaatcacttatggaaatgtttaatataaattttatagtcatagtcattggaacttgcatcctgtattgtaaatataaatgtatatattatgcattaaatcactctgcatatagattgctgttttatacatagtataattttaattcaataaatgagtcaaaatttgtatatttttataaggcttttttataatagcttctttcaaactgtatttccctattatctcagacattggatcagtgaagatcctaggaaagaggctgttattctcatttattttgctatacaggatgtaataggtcaggtatttggtttacttatatttaacaatgtcttatgaattttttttactttatctgttatacaactgattttacatatctgtttggattatagctaggatttggagaataagtgtgtacagatcacaaaacatgtatatacattatttagaaaagatctcaagtctttaattagaatgtctcacttattttgtaaacattttgtgggtacatagtacatgtatatatttacggggtatgtgagatgttttgacacaggcatgcaatgtgaaatacgtgtatcatggagaatgaggtatccatcccctcaagcatttttcctttgaattacagataatccaattacattctttagatcatttaaaaatatacaagtaagttattattgattatagtcactctattgtgctatcagatagtagatcattctttttatcttatttgtttttgtacccattaaccatccccacctccccctgcaaccgtcagtacccttaccagccactggtaaccattcttctactctgtatgcccatgaggtcaattgattttatttttagatcccataaataaatgagaacatgcagtcttnnncnnnnnnnnn

SEQ ID NO: 306993 - DNA, 6477 bp, Homo sapiens
  misc_feature (6465)..(6467): n is a, c, g, or t
  misc_feature (6469)..(6477): n is a, c, g, or t
cattgtttgaatttgaaaacggtaacatcgcagtgctgctcgcgggtctggctagtcaggcgaagtttgcaggtgaggaggtgacccgcgggaatgtgtggggaaggagaatggaatctaattttaatcaagagggagtacctcgaccatcttatgtttttagtgctgacccaattgcaaggccttcagaaataaatttcgatggcattaagcttgatctgtctcatgaattttccttagttgctccaaatactgaggcaaacagtttcgaatctaaagattatctccaggtttgtcttcgaataagaccatttacacagtcagaaaaagaacttgagtctgagggctgtgtgcatattctggattcacagactgttgtgctgaaagagcctcaatgcatccttggtcggttaagtgaaaaaagctcagggcagatggcacagaaattcagtttttccaaggtttttggcccagcaactacacagaaggaattctttcagggttgcattatgcaaccagtaaaagacctcttgaaaggacagagtcgtctgatttttacttacgggctaaccaattcaggaaaaacatatacatttcaagggacagaagaaaatattggcattctgcctcgaactttgaatgtattatttgatagtcttcaagaaagactgtatacaaagatgaaccttaaaccacatagatccagagaatacttaaggttatcatcagaacaagagaaagaagaaattgctagcaaaagtgcattgcttcggcaaattaaagaggttactgtgcataatgatagtgatgatactctttatggaagtttaactaactctttgaatatctcagagtttgaagaatccataaaagattatgaacaagccaacttgaatatggctaatagtataaaattttctgtgtgggtttctttctttgaaatttacaatgaatatatttatgacttatttgttcctgtatcatctaaattccaaaagagaaagatgctgcgcctttcccaagacgtaaagggctattcttttataaaagatctacaatggattcaagtatctgattccaaagaagcctatagacttttaaaactaggaataaagcaccagagtgttgccttcacaaaattgaataatgcttccagtagaagtcacagcatattcactgttaaaatattacagattgaagattctgaaatgtctcgtgtaattcgagtcagtgaattatctttatgtgatcttgctggttcagaacgaactatgaagacacagaatgaaggtgaaaggttaagagagactgggaatatcaacacttctttattgactctgggaaagtgtattaacgtcttgaagaatagtgaaaagtcaaagtttcaacagcatgtgcctttccgggaaagtaaactgactcactattttcaaagtttttttaatggtaaagggaaaatttgtatgattgtcaatatcagccaatgttatttagcctatgatgaaacactcaatgtattgaagttctccgccattgcacaaaaagtttgtgtcccagacactttaaattcctctcaagagaaattatttggacctgtcaaatcttctcaagatgtatcactagacagtaattcaaacagtaaaatattaaatgtaaaaagagccaccatttcatgggaaaatagtctagaagatttgatggaagacgaggatttggttgaggagctagaaaacgctgaagaaactcaaaatgtggaaactaaacttcttgatgaagatctagataaaacattagaggaaaataaggctttcattagccacgaggagaaaagaaaactgttggacttaatagaagacttgaaaaaaaaactgataaatgaaaaaaaggaaaaattaaccttggaatttaaaattcgagaagaagttacacaggagtttactcagtattgggctcaacgggaagctgactttaaggagactctgcttcaagaacgagagatattagaagaaaatgctgaacgtcgtttggctatcttcaaggatttggttggtaaatgtgacactcgagaagaagcagcgaaagacatttgtgccacaaaagttgaaactgaagaaacacataattatgtaggatttgaagatattattgattctcttcaagataatgttgctgatattaagaaacaggctgaaattgctcacttatatattgcatctcttcctgacccccaggaagctactgcttgtttagaactaaagtttaatcaaattaaagctgaattagctaaaaccaaaggagaattaatcaaaaccaaagaagagttaaaaaagagagaaaatgaatcagattcattgattcaagagcttgagacatctaataagaaaataattacacagaatcaaagaattaaagaattgataaatataattgatcaaaaagaagatactatcaacgaatttcagaacctaaagtctcatatggaaaacacatttaaatgcaatgacaaggctgatacatcttctttaataataaacaataaattgatttgtaatgaaacagttgaagtacctaaggacagcaaatctaaaatctgttcagaaagaaaaagagtaaatgaaaatgaacttcagcaagatgaaccaccagcaaagaaagggtctatccatgttagttcagctatcactgaagaccaaaagaaaagtgaagaagtgcgaccgaacattgcagaaattgaagacatcagagttttacaagaaaataatgaaggactgagagcatttttactcactattgagaatgaacttaaaaatgaaaaggaagaaaaagcagaattaaataaacagattgttcattttcagcaggaactttctctttctgaaaaaaagaatttaactttaagtaaagaggtccaacaaattcagtcaaattatgatattgcaattgctgaattacatgtgcagaaaagtaaaaatcaagaacaggaggaaaagatcatgaaattgtcaaatgagatagaaactgctacaagaagcattacaaataatgtttcacaaataaaattaatgcacacgaaaatagacgaactacgtactcttgattcagtttctcagatttcaaacatagatttgctcaatctcagggatctgtcaaatggttctgaggaggataatttgccaaatacacagttagaccttttaggtaatgattatttggtaagtaagcaagttaaagaatatcgaattcaagaacccaatagggaaaattctttccactctagtattgaagctatttgggaagaatgtaaagagattgtgaaggcctcttccaaaaaaagtcatcagattgaggaactggaacaacaaattgaaaaattgcaggcagaagtaaaaggctataaggatgaaaacaatagactaaaggagaaggagcataaaaaccaagatgacctactaaaagaaaaagaaactcttatacagcagctgaaagaagaattgcaagaaaaaaatgttactcttgatgttcaaatacagcatgtagttgaaggaaagagagcgctttcagaacttacacaaggtgttacttgctataaggcaaaaataaaggaacttgaaacaattttagagactcagaaagttgaacgtagtcattcagccaagttagaacaagacattttggaaaaggaatctatcatcttaaagctagaaagaaatttgaaggaatttcaagaacatcttcaggattctgtcaaaaacaccaaagatttaaatgtaaaggaactcaagctgaaagaagaaatcacacagttaacaaataatttgcaagatatgaaacatttacttcaattaaaagaagaagaagaagaaaccaacaggcaagaaacagaaaaattgaaagaggaactctctgcaagctctgctcgtacccagaatctgaaagcagatcttcagaggaaggaagaagattatgctgacctgaaagagaaactgactgatgccaaaaagcagattaagcaagtacagaaagaggtatctgtaatgcgtgatgaggataaattactgaggattaaaattaatgaactggagaaaaagaaaaaccagtgttctcaggaattagatatgaaacagcgaaccattcagcaactcaaggagcagttaaataatcagaaagtggaagaagctatacaacagtatgagagagcatgcaaagatctaaatgttaaagagaaaataattgaagacatgcgaatgacactagaagaacaggaacaaactcaggtagaacaggatcaagtgcttgaggctaaattagaggaagttgaaaggctggccacagaattggaaaaatggaaggaaaaatgcaatgatttggaaaccaaaaacaatcaaaggtcaaataaagaacatgagaacaacacagatgtgcttggaaagctcactaatcttcaagatgagttacaggagtctgaacagaaatataatgctgatagaaagaaatggttagaagaaaaaatgatgcttatcactcaagcgaaagaagcagagaatatacgaaataaagagatgaaaaaatatgctgaggacagggagcgtttttttaagcaacagaatgaaatggaaatactgacagcccagctgacagagaaagatagtgaccttcaaaagtggcgagaagaacgagatcaactggttgcagctttagaaatacagctaaaagcactgatatccagtaatgtacagaaagataatgaaattgaacaactaaaaaggatcatatcagagacttctaaaatagaaacacaaatcatggatatcaagcccaaacgtattagttcagcagatcctgacaaacttcaaactgaacctctatcgacaagttttgaaatttccagaaataaaatagaggatggatctgtagtccttgactcttgtgaagtgtcaacagaaaatgatcaaagcactcgatttccaaaacctgagttagagattcaatttacacctttacagccaaacaaaatggcagtgaaacaccctggttgtaccacaccagtgacagttaagattcccaaggctcggaagaggaagagtaatgaaatggaggaggacttggtgaaatgtgaaaataagaagaatgctacacccagaactaatttgaaatttcctatttcagatgatagaaattcttctgtcaaaaaggaacaaaaggttgccatacgtccatcatctaagaaaacatattctttacggagtcaggcatccataattggtgtaaacctggccactaagaaaaaagaaggaacactacagaaatttggagacttcttacaacattctccctcaattcttcaatcaaaagcaaagaagataattgaaacaatgagctcttcaaagctctcaaatgtagaagcaagtaaagaaaatgtgtctcaaccaaaacgagccaaacggaaattatacacaagtgaaatttcatctcctattgatatatcaggccaagtgattttaatggaccagaaaatgaaggagagtgatcaccagattatcaaacgacgacttcgaacaaaaacagccaaataaatcacttatggaaatgtttaatataaattttatagtcatagtcattggaacttgcatcctgtattgtaaatataaatgtatatattatgcattaaatcactctgcatatagattgctgttttatacatagtataattttaattcaataaatgagtcaaaatttgtatatttttataaggcttttttataatagcttctttcaaactgtatttccctattatctcagacattggatcagtgaagatcctaggaaagaggctgttattctcatttattttgctatacaggatgtaataggtcaggtatttggtttacttatatttaacaatgtcttatgaattttttttactttatctgttatacaactgattttacatatctgtttggattatagctaggatttggagaataagtgtgtacagatcacaaaacatgtatatacattatttagaaaagatctcaagtctttaattagaatgtctcacttattttgtaaacattttgtgggtacatagtacatgtatatatttacggggtatgtgagatgttttgacacaggcatgcaatgtgaaatacgtgtatcatggagaatgaggtatccatcccctcaagcatttttcctttgaattacagataatccaattacattctttagatcatttaaaaatatacaagtaagttattattgattatagtcactctattgtgctatcagatagtagatcattctttttatcttatttgtttttgtacccattaaccatccccacctccccctgcaaccgtcagtacccttaccagccactggtaaccattcttctactctgtatgcccatgaggtcaattgattttatttttagatcccataaataaatgagaacatgcagtcttnnncnnnnnnnnn

SEQ ID NO: 306994 - DNA, 5701 bp, Homo sapiens
cattgtttgaatttgaaaacggtaacatcgcagtgctgctcgcgggtctggctagtcaggcgaagtttgcagaatggaatctaattttaatcaagagggagtacctcgaccatcttatgtttttagtgctgacccaattgcaaggccttcagaaataaatttcgatggcattaagcttgatctgtctcatgaattttccttagttgctccaaatactgaggcaaacagtttcgaatctaaagattatctccaggtttgtcttcgaataagaccatttacacagtcagaaaaagaacttgagtctgagggctgtgtgcatattctggattcacagactgttgtgctgaaagagcctcaatgcatccttggtcggttaagtgaaaaaagctcagggcagatggcacagaaattcagtttttccaaggtttttggcccagcaactacacagaaggaattctttcagggttgcattatgcaaccagtaaaagacctcttgaaaggacagagtcgtctgatttttacttacgggctaaccaattcaggaaaaacatatacatttcaagggacagaagaaaatattggcattctgcctcgaactttgaatgtattatttgatagtcttcaagaaagactgtatacaaagatgaaccttaaaccacatagatccagagaatacttaaggttatcatcagaacaagagaaagaagaaattgctagcaaaagtgcattgcttcggcaaattaaagaggttactgtgcataatgatagtgatgatactctttatggaagtttaactaactctttgaatatctcagagtttgaagaatccataaaagattatgaacaagccaacttgaatatggctaatagtataaaattttctgtgtgggtttctttctttgaaatttacaatgaatatatttatgacttatttgttcctgtatcatctaaattccaaaagagaaagatgctgcgcctttcccaagacgtaaagggctattcttttataaaagatctacaatggattcaagtatctgattccaaagaagcctatagacttttaaaactaggaataaagcaccagagtgttgccttcacaaaattgaataatgcttccagtagaagtcacagcatattcactgttaaaatattacagattgaagattctgaaatgtctcgtgtaattcgagtcagtgaattatctttatgtgatcttgctggttcagaacgaactatgaagacacagaatgaaggtgaaaggttaagagagactgggaatatcaacacttctttattgactctgggaaagtgtattaacgtcttgaagaatagtgaaaagtcaaagtttcaacagcatgtgcctttccgggaaagtaaactgactcactattttcaaagtttttttaatggtaaagggaaaatttgtatgattgtcaatatcagccaatgttatttagcctatgatgaaacactcaatgtattgaagttctccgccattgcacaaaaagtttgtgtcccagacactttaaattcctctcaagagaaattatttggacctgtcaaatcttctcaagatgtatcactagacagtaattcaaacagtaaaatattaaatgtaaaaagagccaccatttcatgggaaaatagtctagaagatttgatggaagacgaggatttggttgaggagctagaaaacgctgaagaaactcaaaatgtggaaactaaacttcttgatgaagatctagataaaacattagaggaaaataaggctttcattagccacgaggagaaaagaaaactgttggacttaatagaagacttgaaaaaaaaactgataaatgaaaaaaaggaaaaattaaccttggaatttaaaattcgagaagaagttacacaggagtttactcagtattgggctcaacgggaagctgactttaaggagactctgcttcaagaacgagagatattagaagaaaatgctgaacgtcgtttggctatcttcaaggatttggttggtaaatgtgacactcgagaagaagcagcgaaagacatttgtgccacaaaagttgaaactgaagaaacacataattatgtaggatttgaagatattattgattctcttcaagataatgttgctgatattaagaaacaggctgaaattgctcacttatatattgcatctcttcctgacccccaggaagctactgcttgtttagaactaaagtttaatcaaattaaagctgaattagctaaaaccaaaggagaattaatcaaaaccaaagaagagttaaaaaagagagaaaatgaatcagattcattgattcaagagcttgagacatctaataagaaaataattacacagaatcaaagaattaaagaattgataaatataattgatcaaaaagaagatactatcaacgaatttcagaacctaaagtctcatatggaaaacacatttaaatgcaatgacaaggctgatacatcttctttaataataaacaataaattgatttgtaatgaaacagttgaagtacctaaggacagcaaatctaaaatctgttcagaaagaaaaagagtaaatgaaaatgaacttcagcaagatgaaccaccagcaaagaaagggtctatccatgttagttcagctatcactgaagaccaaaagaaaagtgaagaagtgcgaccgaacattgcagaaattgaagacatcagagttttacaagaaaataatgaaggactgagagcatttttactcactattgagaatgaacttaaaaatgaaaaggaagaaaaagcagaattaaataaacagattgttcattttcagcaggaactttctctttctgaaaaaaagaatttaactttaagtaaagaggtccaacaaattcagtcaaattatgatattgcaattgctgaattacatgtgcagaaaagtaaaaatcaagaacaggaggaaaagatcatgaaattgtcaaatgagatagaaactgctacaagaagcattacaaataatgtttcacaaataaaattaatgcacacgaaaatagacgaactacgtactcttgattcagtttctcagatttcaaacatagatttgctcaatctcagggatctgtcaaatggttctgaggaggataatttgccaaatacacagttagaccttttaggtaatgattatttggtaagtaagcaagttaaagaatatcgaattcaagaacccaatagggaaaattctttccactctagtattgaagctatttgggaagaatgtaaagagattgtgaaggcctcttccaaaaaaagtcatcagattgaggaactggaacaacaaattgaaaaattgcaggcagaagtaaaaggctataaggatgaaaacaatagactaaaggagaaggagcataaaaaccaagatgacctactaaaagaaaaagaaactcttatacagcagctgaaagaagaattgcaagaaaaaaatgttactcttgatgttcaaatacagcatgtagttgaaggaaagagagcgctttcagaacttacacaaggtgttacttgctataaggcaaaaataaaggaacttgaaacaattttagagactcagaaagttgaacgtagtcattcagccaagttagaacaagacattttggaaaaggaatctatcatcttaaagctagaaagaaatttgaaggaatttcaagaacatcttcaggattctgtcaaaaacaccaaagatttaaatgtaaaggaactcaagctgaaagaagaaatcacacagttaacaaataatttgcaagatatgaaacatttacttcaattaaaagaagaagaagaagaaaccaacaggcaagaaacagaaaaattgaaagaggaactctctgcaagctctgctcgtacccagaatctgaaagcagatcttcagaggaaggaagaagattatgctgacctgaaagagaaactgactgatgccaaaaagcagattaagcaagtacagaaagaggtatctgtaatgcgtgatgaggataaattactgaggattaaaattaatgaactggagaaaaagaaaaaccagtgttctcaggaattagatatgaaacagcgaaccattcagcaactcaaggagcagttaaataatcagaaagtggaagaagctatacaacagtatgagagagcatgcaaagatctaaatgttaaagagaaaataattgaagacatgcgaatgacactagaagaacaggaacaaactcaggtagaacaggatcaagtgcttgaggctaaattagaggaagttgaaaggctggccacagaattggaaaaatggaaggaaaaatgcaatgatttggaaaccaaaaacaatcaaaggtcaaataaagaacatgagaacaacacagatgtgcttggaaagctcactaatcttcaagatgagttacaggagtctgaacagaaatataatgctgatagaaagaaatggttagaagaaaaaatgatgcttatcactcaagcgaaagaagcagagaatatacgaaataaagagatgaaaaaatatgctgaggacagggagcgtttttttaagcaacagaatgaaatggaaatactgacagcccagctgacagagaaagatagtgaccttcaaaagtggcgagaagaacgagatcaactggttgcagctttagaaatacagctaaaagcactgatatccagtaatgtacagaaagataatgaaattgaacaactaaaaaggatcatatcagagacttctaaaatagaaacacaaatcatggatatcaagcccaaacgtattagttcagcagatcctgacaaacttcaaactgaacctctatcgacaagttttgaaatttccagaaataaaatagaggatggatctgtagtccttgactcttgtgaagtgtcaacagaaaatgatcaaagcactcgatttccaaaacctgagttagagattcaatttacacctttacagccaaacaaaatggcagtgaaacaccctggttgtaccacaccagtgacagttaagattcccaaggctcggaagaggaagagtaatgaaatggaggaggacttggtgaaatgtgaaaataagaagaatgctacacccagaactaatttgaaatttcctatttcagatgatagaaattcttctgtcaaaaaggaacaaaaggttgccatacgtccatcatctaagaaaacatattctttacggagtcaggcatccataattggtgtaaacctggccactaagaaaaaagaaggaacactacagaaatttggagacttcttacaacattctccctcaattcttcaatcaaaagcaaagaagataattgaaacaatgagctcttcaaagctctcaaatgtagaagcaagtaaagaaaatgtgtctcaaccaaaacgagccaaacggaaattatacacaagtgaaatttcatctcctattgatatatcaggccaagtgattttaatggaccagaaaatgaaggagagtgatcaccagattatcaaacgacgacttcgaacaaaaacagccaaataaatcacttatggaaatgtttaatataaattttatagtcatagtcattggaacttgcatcctgtattgtaaatataaatgtatatattatgcattaaatcactctgcatatagattgctgttttatacatagtataattttaattcaataaatgagtcaaaatttgt

SEQ ID NO: 306995 - DNA, 4456 bp, Homo sapiens
  misc_feature (4444)..(4446): n is a, c, g, or t
  misc_feature (4448)..(4456): n is a, c, g, or t
ttttttaaaaactgtctaaattagatggtaccacatgtaaagggtgaaccctactgttaatattaggcatgtggtttttgctatttttaggaaacacataattatgtaggatttgaagatattattgattctcttcaagataatgttgctgatattaagaaacaggctgaaattgctcacttatatattgcatctcttcctgacccccaggaagctactgcttgtttagaactaaagtttaatcaaattaaagctgaattagctaaaaccaaaggagaattaatcaaaaccaaagaagagttaaaaaagagagaaaatgaatcagattcattgattcaagagcttgagacatctaataagaaaataattacacagaatcaaagaattaaagaattgataaatataattgatcaaaaagaagatactatcaacgaatttcagaacctaaagtctcatatggaaaacacatttaaatgcaatgacaaggctgatacatcttctttaataataaacaataaattgatttgtaatgaaacagttgaagtacctaaggacagcaaatctaaaatctgttcagaaagaaaaagagtaaatgaaaatgaacttcagcaagatgaaccaccagcaaagaaagggtctatccatgttagttcagctatcactgaagaccaaaagaaaagtgaagaagtgcgaccgaacattgcagaaattgaagacatcagagttttacaagaaaataatgaaggactgagagcatttttactcactattgagaatgaacttaaaaatgaaaaggaagaaaaagcagaattaaataaacagattgttcattttcagcaggaactttctctttctgaaaaaaagaatttaactttaagtaaagaggtccaacaaattcagtcaaattatgatattgcaattgctgaattacatgtgcagaaaagtaaaaatcaagaacaggaggaaaagatcatgaaattgtcaaatgagatagaaactgctacaagaagcattacaaataatgtttcacaaataaaattaatgcacacgaaaatagacgaactacgtactcttgattcagtttctcagatttcaaacatagatttgctcaatctcagggatctgtcaaatggttctgaggaggataatttgccaaatacacagttagaccttttaggtaatgattatttggtaagtaagcaagttaaagaatatcgaattcaagaacccaatagggaaaattctttccactctagtattgaagctatttgggaagaatgtaaagagattgtgaaggcctcttccaaaaaaagtcatcagattgaggaactggaacaacaaattgaaaaattgcaggcagaagtaaaaggctataaggatgaaaacaatagactaaaggagaaggagcataaaaaccaagatgacctactaaaagaaaaagaaactcttatacagcagctgaaagaagaattgcaagaaaaaaatgttactcttgatgttcaaatacagcatgtagttgaaggaaagagagcgctttcagaacttacacaaggtgttacttgctataaggcaaaaataaaggaacttgaaacaattttagagactcagaaagttgaacgtagtcattcagccaagttagaacaagacattttggaaaaggaatctatcatcttaaagctagaaagaaatttgaaggaatttcaagaacatcttcaggattctgtcaaaaacaccaaagatttaaatgtaaaggaactcaagctgaaagaagaaatcacacagttaacaaataatttgcaagatatgaaacatttacttcaattaaaagaagaagaagaagaaaccaacaggcaagaaacagaaaaattgaaagaggaactctctgcaagctctgctcgtacccagaatctgaaagcagatcttcagaggaaggaagaagattatgctgacctgaaagagaaactgactgatgccaaaaagcagattaagcaagtacagaaagaggtatctgtaatgcgtgatgaggataaattactgaggattaaaattaatgaactggagaaaaagaaaaaccagtgttctcaggaattagatatgaaacagcgaaccattcagcaactcaaggagcagttaaataatcagaaagtggaagaagctatacaacagtatgagagagcatgcaaagatctaaatgttaaagagaaaataattgaagacatgcgaatgacactagaagaacaggaacaaactcaggtagaacaggatcaagtgcttgaggctaaattagaggaagttgaaaggctggccacagaattggaaaaatggaaggaaaaatgcaatgatttggaaaccaaaaacaatcaaaggtcaaataaagaacatgagaacaacacagatgtgcttggaaagctcactaatcttcaagatgagttacaggagtctgaacagaaatataatgctgatagaaagaaatggttagaagaaaaaatgatgcttatcactcaagcgaaagaagcagagaatatacgaaataaagagatgaaaaaatatgctgaggacagggagcgtttttttaagcaacagaatgaaatggaaatactgacagcccagctgacagagaaagatagtgaccttcaaaagtggcgagaagaacgagatcaactggttgcagctttagaaatacagctaaaagcactgatatccagtaatgtacagaaagataatgaaattgaacaactaaaaaggatcatatcagagacttctaaaatagaaacacaaatcatggatatcaagcccaaacgtattagttcagcagatcctgacaaacttcaaactgaacctctatcgacaagttttgaaatttccagaaataaaatagaggatggatctgtagtccttgactcttgtgaagtgtcaacagaaaatgatcaaagcactcgatttccaaaacctgagttagagattcaatttacacctttacagccaaacaaaatggcagtgaaacaccctggttgtaccacaccagtgacagttaagattcccaaggctcggaagaggaagagtaatgaaatggaggaggacttggtgaaatgtgaaaataagaagaatgctacacccagaactaatttgaaatttcctatttcagatgatagaaattcttctgtcaaaaaggaacaaaaggttgccatacgtccatcatctaagaaaacatattctttacggagtcaggcatccataattggtgtaaacctggccactaagaaaaaagaaggaacactacagaaatttggagacttcttacaacattctccctcaattcttcaatcaaaagcaaagaagataattgaaacaatgagctcttcaaagctctcaaatgtagaagcaagtaaagaaaatgtgtctcaaccaaaacgagccaaacggaaattatacacaagtgaaatttcatctcctattgatatatcaggccaagtgattttaatggaccagaaaatgaaggagagtgatcaccagattatcaaacgacgacttcgaacaaaaacagccaaataaatcacttatggaaatgtttaatataaattttatagtcatagtcattggaacttgcatcctgtattgtaaatataaatgtatatattatgcattaaatcactctgcatatagattgctgttttatacatagtataattttaattcaataaatgagtcaaaatttgtatatttttataaggcttttttataatagcttctttcaaactgtatttccctattatctcagacattggatcagtgaagatcctaggaaagaggctgttattctcatttattttgctatacaggatgtaataggtcaggtatttggtttacttatatttaacaatgtcttatgaattttttttactttatctgttatacaactgattttacatatctgtttggattatagctaggatttggagaataagtgtgtacagatcacaaaacatgtatatacattatttagaaaagatctcaagtctttaattagaatgtctcacttattttgtaaacattttgtgggtacatagtacatgtatatatttacggggtatgtgagatgttttgacacaggcatgcaatgtgaaatacgtgtatcatggagaatgaggtatccatcccctcaagcatttttcctttgaattacagataatccaattacattctttagatcatttaaaaatatacaagtaagttattattgattatagtcactctattgtgctatcagatagtagatcattctttttatcttatttgtttttgtacccattaaccatccccacctccccctgcaaccgtcagtacccttaccagccactggtaaccattcttctactctgtatgcccatgaggtcaattgattttatttttagatcccataaataaatgagaacatgcagtcttnnncnnnnnnnnn

SEQ ID NO: 306996 - DNA, 3209 bp, Homo sapiens
  misc_feature (3197)..(3199): n is a, c, g, or t
  misc_feature (3201)..(3209): n is a, c, g, or t
gcaatcctcaaaccgtttattgacagcacaaggctcaacagcaggtgagccacgtgagggtggcgagcgcttgcaggcagtgtgggcaccaggcaggggatcccggaggaagccctctgccagggacatggtgagggcgtggcatcacccacgaagggagcataaaaaccaagatgacctactaaaagaaaaagaaactcttatacagcagctgaaagaagaattgcaagaaaaaaatgttactcttgatgttcaaatacagcatgtagttgaaggaaagagagcgctttcagaacttacacaaggtgttacttgctataaggcaaaaataaaggaacttgaaacaattttagagactcagaaagttgaacgtagtcattcagccaagttagaacaagacattttggaaaaggaatctatcatcttaaagctagaaagaaatttgaaggaatttcaagaacatcttcaggattctgtcaaaaacaccaaagatttaaatgtaaaggaactcaagctgaaagaagaaatcacacagttaacaaataatttgcaagatatgaaacatttacttcaattaaaagaagaagaagaagaaaccaacaggcaagaaacagaaaaattgaaagaggaactctctgcaagctctgctcgtacccagaatctgaaagcagatcttcagaggaaggaagaagattatgctgacctgaaagagaaactgactgatgccaaaaagcagattaagcaagtacagaaagaggtatctgtaatgcgtgatgaggataaattactgaggattaaaattaatgaactggagaaaaagaaaaaccagtgttctcaggaattagatatgaaacagcgaaccattcagcaactcaaggagcagttaaataatcagaaagtggaagaagctatacaacagtatgagagagcatgcaaagatctaaatgttaaagagaaaataattgaagacatgcgaatgacactagaagaacaggaacaaactcaggtagaacaggatcaagtgcttgaggctaaattagaggaagttgaaaggctggccacagaattggaaaaatggaaggaaaaatgcaatgatttggaaaccaaaaacaatcaaaggtcaaataaagaacatgagaacaacacagatgtgcttggaaagctcactaatcttcaagatgagttacaggagtctgaacagaaatataatgctgatagaaagaaatggttagaagaaaaaatgatgcttatcactcaagcgaaagaagcagagaatatacgaaataaagagatgaaaaaatatgctgaggacagggagcgtttttttaagcaacagaatgaaatggaaatactgacagcccagctgacagagaaagatagtgaccttcaaaagtggcgagaagaacgagatcaactggttgcagctttagaaatacagctaaaagcactgatatccagtaatgtacagaaagataatgaaattgaacaactaaaaaggatcatatcagagacttctaaaatagaaacacaaatcatggatatcaagcccaaacgtattagttcagcagatcctgacaaacttcaaactgaacctctatcgacaagttttgaaatttccagaaataaaatagaggatggatctgtagtccttgactcttgtgaagtgtcaacagaaaatgatcaaagcactcgatttccaaaacctgagttagagattcaatttacacctttacagccaaacaaaatggcagtgaaacaccctggttgtaccacaccagtgacagttaagattcccaaggctcggaagaggaagagtaatgaaatggaggaggacttggtgaaatgtgaaaataagaagaatgctacacccagaactaatttgaaatttcctatttcagatgatagaaattcttctgtcaaaaaggaacaaaaggttgccatacgtccatcatctaagaaaacatattctttacggagtcaggcatccataattggtgtaaacctggccactaagaaaaaagaaggaacactacagaaatttggagacttcttacaacattctccctcaattcttcaatcaaaagcaaagaagataattgaaacaatgagctcttcaaagctctcaaatgtagaagcaagtaaagaaaatgtgtctcaaccaaaacgagccaaacggaaattatacacaagtgaaatttcatctcctattgatatatcaggccaagtgattttaatggaccagaaaatgaaggagagtgatcaccagattatcaaacgacgacttcgaacaaaaacagccaaataaatcacttatggaaatgtttaatataaattttatagtcatagtcattggaacttgcatcctgtattgtaaatataaatgtatatattatgcattaaatcactctgcatatagattgctgttttatacatagtataattttaattcaataaatgagtcaaaatttgtatatttttataaggcttttttataatagcttctttcaaactgtatttccctattatctcagacattggatcagtgaagatcctaggaaagaggctgttattctcatttattttgctatacaggatgtaataggtcaggtatttggtttacttatatttaacaatgtcttatgaattttttttactttatctgttatacaactgattttacatatctgtttggattatagctaggatttggagaataagtgtgtacagatcacaaaacatgtatatacattatttagaaaagatctcaagtctttaattagaatgtctcacttattttgtaaacattttgtgggtacatagtacatgtatatatttacggggtatgtgagatgttttgacacaggcatgcaatgtgaaatacgtgtatcatggagaatgaggtatccatcccctcaagcatttttcctttgaattacagataatccaattacattctttagatcatttaaaaatatacaagtaagttattattgattatagtcactctattgtgctatcagatagtagatcattctttttatcttatttgtttttgtacccattaaccatccccacctccccctgcaaccgtcagtacccttaccagccactggtaaccattcttctactctgtatgcccatgaggtcaattgattttatttttagatcccataaataaatgagaacatgcagtcttnnncnnnnnnnnn

SEQ ID NO: 306997 - DNA, 2806 bp, Homo sapiens
cattgtttgaatttgaaaacggtaacatcgcagtgctgctcgcgggtctggctagtcaggcgaagtttgcagaatggaatctaattttaatcaagagggagtacctcgaccatcttatgtttttagtgctgacccaattgcaaggccttcagaaataaatttcgatggcattaagcttgatctgtctcatgaattttccttagttgctccaaatactgaggcaaacagtttcgaatctaaagattatctccaggtttgtcttcgaataagaccatttacacagtcagaaaaagaacttgagtctgagggctgtgtgcatattctggattcacagactgttgtgctgaaagagcctcaatgcatccttggtcggttaagtgaaaaaagctcagggcagatggcacagaaattcagtttttccaaggtttttggcccagcaactacacagaaggaattctttcagggttgcattatgcaaccagtaaaagacctcttgaaaggacagagtcgtctgatttttacttacgggctaaccaattcaggaaaaacatatacatttcaagggacagaagaaaatattggcattctgcctcgaactttgaatgtattatttgatagtcttcaagaaagactgtatacaaagatgaaccttaaaccacatagatccagagaatacttaaggttatcatcagaacaagagaaagaagaaattgctagcaaaagtgcattgcttcggcaaattaaagaggttactgtgcataatgatagtgatgatactctttatggaagtttaactaactctttgaatatctcagagtttgaagaatccataaaagattatgaacaagccaacttgaatatggctaatagtataaaattttctgtgtgggtttctttctttgaaatttacaatgaatatatttatgacttatttgttcctgtatcatctaaattccaaaagagaaagatgctgcgcctttcccaagacgtaaagggctattcttttataaaagatctacaatggattcaagtatctgattccaaagaagcctatagacttttaaaactaggaataaagcaccagagtgttgccttcacaaaattgaataatgcttccagtagaagtcacagcatattcactgttaaaatattacagattgaagattctgaaatgtctcgtgtaattcgagtcagtgaattatctttatgtgatcttgctggttcagaacgaactatgaagacacagaatgaaggtgaaaggttaagagagactgggaatatcaacacttctttattgactctgggaaagtgtattaacgtcttgaagaatagtgaaaagtcaaagtttcaacagcatgtgcctttccgggaaagtaaactgactcactattttcaaagtttttttaatggtaaagggaaaatttgtatgattgtcaatatcagccaatgttatttagcctatgatgaaacactcaatgtattgaagttctccgccattgcacaaaaagtttgtgtcccagacactttaaattcctctcaagagaaattatttggacctgtcaaatcttctcaagatgtatcactagacagtaattcaaacagtaaaatattaaatgtaaaaagagccaccatttcatgggaaaatagtctagaagatttgatggaagacgaggatttggttgaggagctagaaaacgctgaagaaactcaaaatgtggaaactaaacttcttgatgaagatctagataaaacattagaggaaaataaggctttcattagccacgaggagaaaagaaaactgttggacttaatagaagacttgaaaaaaaaactgataaatgaaaaaaaggaaaaattaaccttggaatttaaaattcgagaagaagttacacaggagtttactcagtattgggctcaacgggaagctgactttaaggagactctgcttcaagaacgagagatattagaagaaaatgctgaacgtcgtttggctatcttcaaggatttggttggtaaatgtgacactcgagaagaagcagcgaaagacatttgtgccacaaaagttgaaactgaagaagctactgcttgtttagaactaaagtttaatcaaattaaagctgaattagctaaaaccaaaggagaattaatcaaaaccaaagaagagttaaaaaagagagaaaatgaatcagattcattgattcaagagcttgagacatctaataagaaaataattacacagaatcaaagaattaaagaattgataaatataattgatcaaaaagaagatactatcaacgaatttcagaacctaaagtctcatatggaaaacacatttaaatgcaatgacaaggctgatacatcttctttaataataaacaataaattgatttgtaatgaaacagttgaagtacctaaggacagcaaatctaaaatctgttcagaaagaaaaagagtaaatgaaaatgaacttcagcaagatgaaccaccagcaaagaaaggtactacttcagctgccagcagcaggcgtttaagaaagctaatttctaaaccagtaaatagaacaaggcaaacagaggggcattcacttgtctaaggaaaaatcttgagaaaatctaaacgtcttgaatttttattctggaaagttatacattttctagggatgggcatagttaaagcttttatcttaataaatatgcttttagaaattgtgcttttattatttctttcgcagtctatgtaataatttctgtgcttataatagttaaaactcattactttgattttataaatatagtattttctgcct

SEQ ID NO: 306998 - DNA, 2276 bp, Homo sapiens
cattgtttgaatttgaaaacggtaacatcgcagtgctgctcgcgggtctggctagtcaggcgaagtttgcagaatggaatctaattttaatcaagagggagtacctcgaccatcttatgtttttagtgctgacccaattgcaaggccttcagaaataaatttcgatggcattaagcttgatctgtctcatgaattttccttagttgctccaaatactgaggcaaacagtttcgaatctaaagattatctccaggtttgtcttcgaataagaccatttacacagtcagaaaaagaacttgagtctgagggctgtgtgcatattctggattcacagactgttgtgctgaaagagcctcaatgcatccttggtcggttaagtgaaaaaagctcagggcagatggcacagaaattcagtttttccaaggtttttggcccagcaactacacagaaggaattctttcagggttgcattatgcaaccagtaaaagacctcttgaaaggacagagtcgtctgatttttacttacgggctaaccaattcaggaaaaacatatacatttcaagggacagaagaaaatattggcattctgcctcgaactttgaatgtattatttgatagtcttcaagaaagactgtatacaaagatgaaccttaaaccacatagatccagagaatacttaaggttatcatcagaacaagagaaagaagaaattgctagcaaaagtgcattgcttcggcaaattaaagaggttactgtgcataatgatagtgatgatactctttatggaagtttaactaactctttgaatatctcagagtttgaagaatccataaaagattatgaacaagccaacttgaatatggctaatagtataaaattttctgtgtgggtttctttctttgaaatttacaatgaatatatttatgacttatttgttcctgtatcatctaaattccaaaagagaaagatgctgcgcctttcccaagacgtaaagggctattcttttataaaagatctacaatggattcaagtatctgattccaaagaagcctatagacttttaaaactaggaataaagcaccagagtgttgccttcacaaaattgaataatgcttccagtagaagtcacagcatattcactgttaaaatattacagattgaagattctgaaatgtctcgtgtaattcgagtcagtgaattatctttatgtgatcttgctggttcagaacgaactatgaagacacagaatgaaggtgaaaggttaagagagactgggaatatcaacacttctttattgactctgggaaagtgtattaacgtcttgaagaatagtgaaaagtcaaagtttcaacagcatgtgcctttccgggaaagtaaactgactcactattttcaaagtttttttaatggtaaagggaaaatttgtatgattgtcaatatcagccaatgttatttagcctatgatgaaacactcaatgtattgaagttctccgccattgcacaaaaagtttgtgtcccagacactttaaattcctctcaagagaaattatttggacctgtcaaatcttctcaagatgtatcactagacagtaattcaaacagtaaaatattaaatgtaaaaagagccaccatttcatgggaaaatagtctagaagatttgatggaagacgaggatttggttgaggagctagaaaacgctgaagaaactcaaaatgtggaaactaaacttcttgatgaagatctagataaaacattagaggaaaataaggctttcattagccacgaggagaaaagaaaactgttggacttaatagaagacttgaaaaaaaaactgataaatgaaaaaaaggaaaaattaaccttggaatttaaaattcgagaagaagttacacaggagtttactcagtattgggctcaacgggaagctgactttaaggagactctgcttcaagaacgagagatattagaagaaaatgctgaacgtcgtttggctatcttcaaggatttggttggtaaatgtgacactcgagaagaagcagcgaaagacatttgtgccacaaaagttgaaactgaagaagctactgcttgtttagaactaaagtttaatcaaattaaagctgaattagctaaaaccaaaggagaattaatcaaaaccaaagaagagttaaaaaagagagaaaatgaatcagattcattgattcaagagcttgagacatctaataagaaaataattacacagaatcaaagaattaaagaattgataaatataattgatc

SEQ ID NO: 306999 - DNA, 2183 bp, Homo sapiens
cattgtttgaatttgaaaacggtaacatcgcagtgctgctcgcgggtctggctagtcaggcgaagtttgcagaatggaatctaattttaatcaagagggagtacctcgaccatcttatgtttttagtgctgacccaattgcaaggccttcagaaataaatttcgatggcattaagcttgatctgtctcatgaattttccttagttgctccaaatactgaggcaaacagtttcgaatctaaagattatctccaggtttgtcttcgaataagaccatttacacagtcagaaaaagaacttgagtctgagggctgtgtgcatattctggattcacagactgttgtgctgaaagagcctcaatgcatccttggtcggttaagtgaaaaaagctcagggcagatggcacagaaattcagtttttccaaggtttttggcccagcaactacacagaaggaattctttcagggttgcattatgcaaccagtaaaagacctcttgaaaggacagagtcgtctgatttttacttacgggctaaccaattcaggaaaaacatatacatttcaagggacagaagaaaatattggcattctgcctcgaactttgaatgtattatttgatagtcttcaagaaagactgtatacaaagatgaaccttaaaccacatagatccagagaatacttaaggttatcatcagaacaagagaaagaagaaattgctagcaaaagtgcattgcttcggcaaattaaagaggttactgtgcataatgatagtgatgatactctttatggaagtttaactaactctttgaatatctcagagtttgaagaatccataaaagattatgaacaagccaacttgaatatggctaatagtataaaattttctgtgtgggtttctttctttgaaatttacaatgaatatatttatgacttatttgttcctgtatcatctaaattccaaaagagaaagatgctgcgcctttcccaagacgtaaagggctattcttttataaaagatctacaatggattcaagtatctgattccaaagaagcctatagacttttaaaactaggaataaagcaccagagtgttgccttcacaaaattgaataatgcttccagtagaagtcacagcatattcactgttaaaatattacagattgaagattctgaaatgtctcgtgtaattcgagtcagtgaattatctttatgtgatcttgctggttcagaacgaactatgaagacacagaatgaaggtgaaaggttaagagagactgggaatatcaacacttctttattgactctgggaaagtgtattaacgtcttgaagaatagtgaaaagtcaaagtttcaacagcatgtgcctttccgggaaagtaaactgactcactattttcaaagtttttttaatggtaaagggaaaatttgtatgattgtcaatatcagccaatgttatttagcctatgatgaaacactcaatgtattgaagttctccgccattgcacaaaaagtttgtgtcccagacactttaaattcctctcaagagaaattatttggacctgtcaaatcttctcaagatgtatcactagacagtaattcaaacagtaaaatattaaatgtaaaaagagccaccatttcatgggaaaatagtctagaagatttgatggaagacgaggatttggttgaggagctagaaaacgctgaagaaactcaaaatgtggaaactaaacttcttgatgaagatctagataaaacattagaggaaaataaggctttcattagccacgaggagaaaagaaaactgttggacttaatagaagacttgaaaaaaaaactgataaatgaaaaaaaggaaaaattaaccttggaatttaaaattcgagaagaagttacacaggagtttactcagtattgggctcaacgggaagctgactttaaggagactctgcttcaagaacgagagatattagaagaaaatgctgaacgtcgtttggctatcttcaaggatttggttggtaaatgtgacactcgagaagaagcagcgaaagacatttgtgccacaaaagttgaaactgaagaagctactgcttgtttagaactaaagtttaatcaaattaaagctgaattagctaaaaccaaaggagaattaatcaaaaccaaagaagagttaaaaaagagagaaaatg

SEQ ID NO: 307000 - DNA, 1542 bp, Homo sapiens
cattgtttgaatttgaaaacggtaacatcgcagtgctgctcgcgggtctggctagtcaggcgaagtttgcagaatggaatctaattttaatcaagagggagtacctcgaccatcttatgtttttagtgctgacccaattgcaaggccttcagaaataaatttcgatggcattaagcttgatctgtctcatgaattttccttagttgctccaaatactgaggcaaacagtttcgaatctaaagattatctccaggtttgtcttcgaataagaccatttacacagtcagaaaaagaacttgagtctgagggctgtgtgcatattctggattcacagactgttgtgctgaaagagcctcaatgcatccttggtcggttaagtgaaaaaagctcagggcagatggcacagaaattcagtttttccaaggtttttggcccagcaactacacagaaggaattctttcagggttgcattatgcaaccagtaaaagacctcttgaaaggacagagtcgtctgatttttacttacgggctaaccaattcaggaaaaacatatacatttcaagggacagaagaaaatattggcattctgcctcgaactttgaatgtattatttgatagtcttcaagaaagactgtatacaaagatgaaccttaaaccacatagatccagagaatacttaaggttatcatcagaacaagagaaagaagaaattgctagcaaaagtgcattgcttcggcaaattaaagaggttactgtgcataatgatagtgatgatactctttatggaagtttaactaactctttgaatatctcagagtttgaagaatccataaaagattatgaacaagccaacttgaatatggctaatagtataaaattttctgtgtgggtttctttctttgaaatttacaatgaatatatttatgacttatttgttcctgtatcatctaaattccaaaagagaaagatgctgcgcctttcccaagacgtaaagggctattcttttataaaagatctacaatggattcaagtatctgattccaaagaagcctatagacttttaaaactaggaataaagcaccagagtgttgccttcacaaaattgaataatgcttccagtagaagtcacagcatattcactgttaaaatattacagattgaagattctgaaatgtctcgtgtaattcgagtcagtgaattatctttatgtgatcttgctggttcagaacgaactatgaagacacagaatgaaggtgaaaggttaagagagactgggaatatcaacacttctttattgactctgggaaagtgtattaacgtcttgaagaatagtgaaaagtcaaagtaagtgtttctgaaagtgttattagcatattaaatattacaatatttaaactttcaacttttttgtttttagaaagttcttttttgatttttaaactgcttcttatgtaatgactgtgtatagattgtgattcaagtacttaagagatcttggattaaagacaatgatagaaatgtcagttgatgccagtaactcat

SEQ ID NO: 307001 - DNA, 1143 bp, Homo sapiens
cattgtttgaatttgaaaacggtaacatcgcagtgctgctcgcgggtctggctagtcaggcgaagtttgcaggtgaggaggtgacccgcgggaatgtgtggggaaggagaatggaatctaattttaatcaagagggagtacctcgaccatcttatgtttttagtgctgacccaattgcaaggccttcagaaataaatttcgatggcattaagcttgatctgtctcatgaattttccttagttgctccaaatactgaggcaaacagtttcgaatctaaagattatctccaggtttgtcttcgaataagaccatttacacagtcagaaaaagaacttgagtctgagggctgtgtgcatattctggattcacagactgttgtgctgaaagagcctcaatgcatccttggtcggttaagtgaaaaaagctcagggcagatggcacagaaattcagtttttccaaggtttttggcccagcaactacacagaaggaattctttcagggttgcattatgcaaccagtaaaagacctcttgaaaggacagagtcgtctgatttttacttacgggctaaccaattcaggaaaaacatatacatttcaagggacagaagaaaatattggcattctgcctcgaactttgaatgtattatttgatagtcttcaagaaagactgtatacaaagatgaaccttaaaccacatagatccagagaatacttaaggttatcatcagaacaagagaaagaagaaattgctagcaaaagtgcattgcttcggcaaattaaagaggttactgtgcataatgatagtgatgatactctttatggaagtttaactaactctttgaatatctcagagtttgaagaatccataaaagattatgaacaagccaacttgaatatggctaatagtataaaattttctgtgtgggtttctttctttgaaatttacaatgaatatatttatgacttatttgttcctgtatcatctaaattccaaaaaaccaaaggagaattaatcaaaaccaaagaagagttaaaaaagagagaaaatgaatcagattcattgattcaagagcttgagacatctaataagaaaataattacacagaatcaaagaattaaagaattgataaatataattgatc

SEQ ID NO: 307002 - DNA, 277 bp, Homo sapiens
gagatttatcttcttaagattctccagttatccccaaatgttacttatttgctagagccatcagttattttaggacgaaacttaagaaataacttagaaaatgtctcaacaaatttgaaaataaaatttttatggtacaccattgaaagtaatttatgtgatttgtacattttttgtagctttctatatgtgaattatttttaacttattttgctttaggacaaggctgatacatcttctttaataataaacaataaattgatttgtaatgaaacag

SEQ ID NO: 307003 - DNA, 2377 bp, Homo sapiens
cctgagggagtcctggtggagaagacacacagctcattgctgtgcccaaaaggaaaggtggcatctgaatctgtctccctggagctcccagtggacattgttcctgactcgaccaaggcttatgttacggttctgggagacattatgggcacagccctgcagaacctggatggtctggtgcagatgcccagtggctgtggcgagcagaacatggtcttgtttgctcccatcatctatgtcttgcagtacctggagaaggcagggctgctgacggaggagatcaggtctcgggcagtgggtttcctggaaatagggtaccagaaggagctgatgtacaaacacagcaatggctcatacagtgcctttggggagcgagatggaaatggaaacacatggctgacagcgtttgtcacaaaatgctttggccaagctcagaaattcatcttcattgatcccaagaacatccaggatgctctcaagtggatggcaggaaaccagctccccagtggctgctatgccaacgtgggaaatctccttcacacagctatgaagggtggtgttgatgatgaggtctccttgactgcgtatgtcacagctgcattgctggagatgggaaaggatgtagatgacccaatggtgagtcagggtctacggtgtctcaagaattcggccacctccacgaccaacctctacacacaggccctgttggcttacattttctccctggctggggaaatggacatcagaaacattctccttaaacagttagatcaacaggctatcatctcaggagaatccatttactggagccagaaacctactccatcatcgaacgccagcccttggtctgagcctgcggctgtagatgtggaactcacagcatatgcattgttggcccagcttaccaagcccagcctgactcaaaaggagatagcgaaggccactagcatagtggcttggttggccaagcaacgcaatgcatatgggggcttctcttctactcaggatactgtagttgctctccaagctcttgccaaatatgccactaccgcctacgtgccatctgaggagatcaacctggttgtaaaatccactgagaatttccagcgcacattcaacatacagtcagttaacagattggtatttcagcaggataccctgcccaatgtccctggaatgtacacgttggaggcctcaggccagggctgtgtctatgtgcagacggtgttgagatacaatattctccctcccacaaatatgaagacctttagtcttagtgtggaaataggaaaagctagatgtgagcaaccgacttcacctcgatccttgactctcactattcacaccagttatgtggggagccgtagctcttccaatatggctattgtggaagtgaagatgctatctgggttcagtcccatggagggcaccaatcagttacttctccagcaacccctggtgaagaaggttgaatttggaactgacacacttaacatttacttggatgagctcattaagaacactcagacttacaccttcaccatcagccaaagtgtgctggtcaccaacttgaaaccagcaaccatcaaggtctatgactactacctaccagatgaacaggcaacaattcagtattctgatccctgtgaatgaggataggagctggaaactcaattagtcctctgtgacattactggagggtggaacattcttctgtcgcttgaagcagaactcattcaatcaaataatttaatttctctgactagtatatgggtaacaaatgaatatgtctgaacctcagctataatactttctactacctttgcaaggagatgggataggaacaatcactcagaggaggcgttgcatggacagggtcatagggggaagaaaggtggtttagctgttttatttagccattcagggggctctccagagaggagacggtggtagagggtgaactagagaagataagaatgtcttcctaggccggatgcggtggctcacgcctgtaatcccagcactttgggattgcgaggtgggcggatcacttgaggtcaggagttcaagaccagcctggccaacatggtaaaacccgtctctactaacaatacaaagattagcctggtgtggtggcacgggcctgtaatcgcagccccttggaaggccaaggcaggagaatcgcctcaacactggaggtggaggttgcagtgagctgagattgtgccactgcactccagcctgggcaatgaggcaagaccctgtctcaaaaaataataaataataataataataatgtttttctagagtttcagtctaagggaaaatgtgatttagggctttggaaattggctaaaaaaataaaaatggaaaagaa

SEQ ID NO: 307004 - DNA, 2213 bp, Homo sapiens
tatggggaaagcataactgtgatctgctgaggatgctggagtgatttgctcaaagggagcagatctgagcctgagactggtagatggagtcactgaatgttcaggaagattagaagtgagattccaaggggaatgggggacaatatgtgatgacggctgggacagctacgatgctgctgtggcatgcaagcaactgggatgtccaactgccgtcacagccattggtcgagttaacgccagtaagggatttggacacatctggcttgacagcgtttcttgccagggacatgaacctgctgtctggcaatgtaaacaccatgaatggggaaaccagctccccagtggctgctatgccaacgtgggaaatctccttcacacagctatgaagggtggtgttgatgatgaggtctccttgactgcgtatgtcacagctgcattgctggagatgggaaaggatgtagatgacccaatggtgagtcagggtctacggtgtctcaagaattcggccacctccacgaccaacctctacacacaggccctgttggcttacattttctccctggctggggaaatggacatcagaaacattctccttaaacagttagatcaacaggctatcatctcaggagaatccatttactggagccagaaacctactccatcatcgaacgccagcccttggtctgagcctgcggctgtagatgtggaactcacagcatatgcattgttggcccagcttaccaagcccagcctgactcaaaaggagatagcgaaggccactagcatagtggcttggttggccaagcaacgcaatgcatatgggggcttctcttctactcaggatactgtagttgctctccaagctcttgccaaatatgccactaccgcctacgtgccatctgaggagatcaacctggttgtaaaatccactgagaatttccagcgcacattcaacatacagtcagttaacagattggtatttcagcaggataccctgcccaatgtccctggaatgtacacgttggaggcctcaggccagggctgtgtctatgtgcagacggtgttgagatacaatattctccctcccacaaatatgaagacctttagtcttagtgtggaaataggaaaagctagatgtgagcaaccgacttcacctcgatccttgactctcactattcacaccagttatgtggggagccgtagctcttccaatatggctattgtggaagtgaagatgctatctgggttcagtcccatggagggcaccaatcagttacttctccagcaacccctggtgaagaaggttgaatttggaactgacacacttaacatttacttggatgagctcattaagaacactcagacttacaccttcaccatcagccaaagtgtgctggtcaccaacttgaaaccagcaaccatcaaggtctatgactactacctaccagatgaacaggcaacaattcagtattctgatccctgtgaatgaggataggagctggaaactcaattagtcctctgtgacattactggagggtggaacattcttctgtcgcttgaagcagaactcattcaatcaaataatttaatttctctgactagtatatgggtaacaaatgaatatgtctgaacctcagctataatactttctactacctttgcaaggagatgggataggaacaatcactcagaggaggcgttgcatggacagggtcatagggggaagaaaggtggtttagctgttttatttagccattcagggggctctccagagaggagacggtggtagagggtgaactagagaagataagaatgtcttcctaggccggatgcggtggctcacgcctgtaatcccagcactttgggattgcgaggtgggcggatcacttgaggtcaggagttcaagaccagcctggccaacatggtaaaacccgtctctactaacaatacaaagattagcctggtgtggtggcacgggcctgtaatcgcagccccttggaaggccaaggcaggagaatcgcctcaacactggaggtggaggttgcagtgagctgagattgtgccactgcactccagcctgggcaatgaggcaagaccctgtctcaaaaaataataaataataataataataatgtttttctagagtttcagtctaagggaaaatgtgatttagggctttggaaattggctaaaaaaataaaaatggaaaagaa

SEQ ID NO: 307005 - DNA, 1824 bp, Homo sapiens
cctgagggagtcctggtggagaagacacacagctcattgctgtgcccaaaaggaaaggtggcatctgaatctgtctccctggagctcccagtggacattgttcctgactcgaccaaggcttatgttacggttctgggagacattatgggcacagccctgcagaacctggatggtctggtgcagatgcccagtggctgtggcgagcagaacatggtcttgtttgctcccatcatctatgtcttgcagtacctggagaaggcagggctgctgacggaggagatcaggtctcgggcagtgggtttcctggaaatagggtaccagaaggagctgatgtacaaacacagcaatggctcatacagtgcctttggggagcgagatggaaatggaaacacatggctgacagcgtttgtcacaaaatgctttggccaagctcagaaattcatcttcattgatcccaagaacatccaggatgctctcaagtggatggcaggaaaccagctccccagtggctgctatgccaacgtgggaaatctccttcacacagctatgaagggtggtgttgatgatgaggtctccttgactgcgtatgtcacagctgcattgctggagatgggaaaggatgtagatgacccaatggtgagtcagggtctacggtgtctcaagaattcggccacctccacgaccaacctctacacacaggccctgttggcttacattttctccctggctggggaaatggacatcagaaacattctccttaaacagttagatcaacaggctatcatctcaggagaatccatttactggagccagaaacctactccatcatcgaacgccagcccttggtctgagcctgcggctgtagatgtggaactcacagcatatgcattgttggcccagcttaccaagcccagcctgactcaaaaggagatagcgaaggccactagcatagtggcttggttggccaagcaacgcaatgcatatgggggcttctcttctactcaggatactgtagttgctctccaagctcttgccaaatatgccactaccgcctacgtgccatctgaggagatcaacctggttgtaaaatccactgagaatttccagcgcacattcaacatacagtcagttaacagattggtatttcagcaggataccctgcccaatgtccctggaatgtacacgttggaggcctcaggccagggctgtgtctatgtgcagacggtgttgagatacaatattctccctcccacaaatatgaagacctttagtcttagtgtggaaataggaaaagctagatgtgagcaaccgacttcacctcgatccttgactctcactattcacaccagttatgtggggagccgtagctcttccaatatggctattgtggaagtgaagatgctatctgggttcagtcccatggagggcaccaatcagttacttctccagcaacccctggtgaagaaggttgaatttggaactgacacacttaacatttacttggatgagctcattaagaacactcagacttacaccttcaccatcagccaaagtgtgctggtcaccaacttgaaaccagcaaccatcaaggtctatgactactacctaccagatgaacaggcaacaattcagtattctgatccctgtgaatgaggataggagctggaaactcaattagtcctctgtgacattactggagggtggaacattcttctgtcgcttgaagcagaactcattcaatcaaataatttaatttctcttctgaactaagaggggttaccgaagcctcgaaattcgtaaattcatgggtcattagcctggttt

SEQ ID NO: 307006 - DNA, 676 bp, Homo sapiens
cctgagggagtcctggtggagaagacacacagctcattgctgtgcccaaaaggaaaggtggcatctgaatctgtctccctggagctcccagtggacattgttcctgactcgaccaaggcttatgttacggttctgggagacattatgggcacagccctgcagaacctggatggtctggtgcagatgcccagtggctgtggcgagcagaacatggtcttgtttgctcccatcatctatgtcttgcagtacctggagaaggcagggctgctgacggaggagatcaggtctcgggcagtgggtttcctggaaatagggtaccagaaggagctgatgtacaaacacagcaatggctcatacagtgcctttggggagcgagatggaaatggaaacacatggtaatatcacccaattcccaatgagttctgtactccagagcataattcctgagccctctggaactattccactacctctccccttaacccctttccttcttgcactcagtcttctacctctttaatactgtttatttcaccctcatggatggtcaagtccctcgatcttcctgagcttgtgcctcccctgttcttgtcctcattggtgcccattaatgcctctcttttctaggcctgctatggcatatgttccctcagctccccttctggaagtatacacc

SEQ ID NO: 307007 - DNA, 175 bp, Homo sapiens
catcatccaagccaactaacaacaaccagatgtgtgggttatagagttgttcaaggttaattccaatggctcacaaaatggtaagtatacgtttggttgtttccctcaggatactgtagttgctctccaagctcttgccaaatatgccactaccgcctacgtgccatctgaggag

SEQ ID NO: 307008 - DNA, 2720 bp, Homo sapiens
ttgcactctcccacacccttttcttttcgtccgctcttcgcttatttctcccgccgtgggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagaggaggatcctgagcacagagtccgggtccgggtcaccaagctccgtctcggaggccctaatcaggatctgactgtcctcgagatgaaacgggaaaacccacagctgaaacaaatcgaggggctggtgaaggagctgctggagagggagggactcacagctgcagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaa

SEQ ID NO: 307009 - DNA, 3971 bp, Homo sapiens
ggcacgaggggtttctctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaaaaaaaaactcgagttttttttttttttttttacagaaacagtttttagtttttaatgaacttgtaaacaaaaaagctcccatttcaaaataaaaacaaaatcccagatcatatagatgtttacagtgattacatttatctaagcaacatacatacatgttcagttgtaagatgttaactaaatttctgtgacaaatatgctttttttttaataccaagaacattatagagttaatgcagagtcctaaggataatctagtagtcactaagtttttcttaagtcttcactttagatgctgttatttctagcacaattaagcaggcagagtctttcatatgctcaaacactggaatctttggttgctaccatatcagctggcttgcagacaagaagccaaccattttaagaatgttttaagtgaacaacttgcaaaccccagggatggaaaaaccctaagaatgcacaattgtgagcatttaacaaccatcacaactgtggctgaagactgttcatgccgttcttctgaaatgagatctcaaagcagtatagttcaaaacaaaaggttttaacaaaaaattggcatatgcacaatttctccaccaatttttgtgtgtcaaccatttagttaacttttccacttgaaaaatgcaatagaaaaccggacaccatgtttcactatctcagttaatattcacaattacagaggctacaactcaggatacagcatcaccaatgctgcccagagtcagtttatactgaaattaagttctttacaccaagtaaatggttgtccacaaccactggctagtgtacatatgaactaaaatttctagatttggggagaaacaaatgctgctccgatcatctgctctgcttcttattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaa

SEQ ID NO: 307010 - DNA, 235 bp, Homo sapiens
cctggaaaaggggaaggagagtctgttggagaagaggctggtggcagaggaggaagaggacgaagaggaggcagaagcaggaagcggcagaagcaggaagcggtcagatttctggaagatgcttaatgagccagaggaccaggccccaggaggggaggaggtgccggctgaggagcaggacccaagacctcggggcagaagcaggaagcagaagcaggaagcggcagaagcgaag

SEQ ID NO: 307011 - DNA, 4036 bp, Homo sapiens
cttatctttatggagggcaaataaggatttaaaaaatcttttaaaagggaggaatggaaagaccacaagtggaaaacagactttagagatatctctccaagtcacagaaggaaagcagccctccctccttactgaaagtctggagaattgagagtggaagtgaagggaagagaattgagtgtgtaagtagatgagaggttatgtgtcttggagccaggagactctggttccaagaaaagatgtctgcactccatccccctgattgtttattttttaattgtcagacaaaggactggtggacatatgaattctgttatggacgccacatccagcaataccacatggaagattcagagatcaaaggtgaagtcctctatctcggctactaccaatcagccttcgactgggatgatgaaacagccaaggtggcaagagtgtgggattcaggaagaaagggttctggccaccggctgagagccctgacaagaaggggagggtcaagattagctgatctgtttcttggggcttggtggccattaggacaaagtttcctggggcctgggggcacaggccattcttttgtctctttggggacgcagtgccatccttcctctttgctatctttctcatgtcccccattcctgcctcatgtcttctccaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccggtgagtaattagagaaggaggagaagacggggagatacgggggcagggggtggcaaaagatcaagtattgaatagctggaggaatgtgttcctggcctgcttgcatgctgtttctcagtagactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacaggtgagagcagtcagacaagaaagagtagcccagtctgttgttttcatccctcagctggttctgttcccagaggggaccctgttccttcccttctgagggtgctcattctctccccactttctggaacactgtcctcacttgcgcctgcttcccaacaccgtcatccctttgcgtgtttacctcctattcatctctctgggaagcagcttttagagcatatctgctggttttctggtttgctcctgtacacccagtgcctagcactctgcctggcacacaatggatgatcagtagctagtaattgaatgcttgtgagtctatatgctgaaaaccactttaggactttgcaccaagagaggccccagctgtcagggcatgaataggagagcccagctgcacatgagccaatagcttggatagactttaaattatttcttcttcttgtatccccttgtgtccatttcatagtgtcctatgggtgtggacatcagatattctaaatggaatgttccagtttcaaaccttccattcccactctctctataaacattgaaatgtctttaaagtcccaacatatggaggaggagaccacacttttccaacctgcttcttcaaacagaactttgttggtgcaggtggcctgattttggctttagaaaacatttgttttcctataggtgacgggcagaattattgggtagggcgggaagatggaaggctgcaattggtggagggagctctacaggctgaactgggaggggcggggcacacatttttttgagccctggctcatatacatgttgagatggaagagctgccaaagccaactgatgttttagggggagatgacccccacacccctaaccctggagtcacgcctctgctttgtgtttccctgtgtgtctccccctctaagaggaggatcctgagcacagagtccgggtccgggtcaccaagctccgtctcggaggccctaatcaggatctgactgtcctcgagatgaaacgggaaaacccacagctgaaacaaatcgaggggctggtgaaggagctgctggagagggagggactcacagctgcagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaaaaaaaaaaaagaaaaaaaatttgtggggcgctcgcccgaaaattttcacacctcgtggggcggcccaagggagagaaatgcccacgggtccaagaacacggcagaaaggtggttccccaaaaagccgggccgcgttggacaccagggctggggtcggccaaaggcg

SEQ ID NO: 307012 - DNA, 2711 bp, Homo sapiens
gaggccgctgcctggcttagggcggaaacagattctctgcataagaaggggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagaggaggatcctgagcacagagtccgggtccgggtcaccaagctccgtctcggaggccctaatcaggatctgactgtcctcgagatgaaacgggaaaacccacagctgaaacaaatcgaggggctggtgaaggagctgctggagagggagggactcacagctgcagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaa

SEQ ID NO: 307013 - DNA, 2704 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (34)..(34): n is a, c, g, or t
accgtgcagtactntnacggtttanggtagcgangctgggtgggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagaggaggatcctgagcacagagtccgggtccgggtcaccaagctccgtctcggaggccctaatcaggatctgactgtcctcgagatgaaacgggaaaacccacagctgaaacaaatcgaggggctggtgaaggagctgctggagagggagggactcacagctgcagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaa

SEQ ID NO: 307014 - DNA, 2748 bp, Homo sapiens
gttggcctactggaaaaataaaaaaaaaaggagaaaaaaaaaaaaaaaaaaaaaaaaaaaaaaaaaaaaaaaaaaaaaaaggagggggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagaggaggatcctgagcacagagtccgggtccgggtcaccaagctccgtctcggaggccctaatcaggatctgactgtcctcgagatgaaacgggaaaacccacagctgaaacaaatcgaggggctggtgaaggagctgctggagagggagggactcacagctgcagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaa

SEQ ID NO: 307015 - DNA, 2539 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (34)..(34): n is a, c, g, or t
accgtgcagtactntnacggtttanggtagcgangctgggtgggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaa

SEQ ID NO: 307016 - DNA, 3620 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (34)..(34): n is a, c, g, or t
accgtgcagtactntnacggtttanggtagcgangctgggtgggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacaggtgagagcagtcagacaagaaagagtagcccagtctgttgttttcatccctcagctggttctgttcccagaggggaccctgttccttcccttctgagggtgctcattctctccccactttctggaacactgtcctcacttgcgcctgcttcccaacaccgtcatccctttgcgtgtttacctcctattcatctctctgggaagcagcttttagagcatatctgctggttttctggtttgctcctgtacacccagtgcctagcactctgcctggcacacaatggatgatcagtagctagtaattgaatgcttgtgagtctatatgctgaaaaccactttaggactttgcaccaagagaggccccagctgtcagggcatgaataggagagcccagctgcacatgagccaatagcttggatagactttaaattatttcttcttcttgtatccccttgtgtccatttcatagtgtcctatgggtgtggacatcagatattctaaatggaatgttccagtttcaaaccttccattcccactctctctataaacattgaaatgtctttaaagtcccaacatatggaggaggagaccacacttttccaacctgcttcttcaaacagaactttgttggtgcaggtggcctgattttggctttagaaaacatttgttttcctataggtgacgggcagaattattgggtagggcgggaagatggaaggctgcaattggtggagggagctctacaggctgaactgggaggggcggggcacacatttttttgagccctggctcatatacatgttgagatggaagagctgccaaagccaactgatgttttagggggagatgacccccacacccctaaccctggagtcacgcctctgctttgtgtttccctgtgtgtctccccctctaagaggaggatcctgagcacagagtccgggtccgggtcaccaagctccgtctcggaggccctaatcaggatctgactgtcctcgagatgaaacgggaaaacccacagctgaaacaaatcgaggggctggtgaaggagctgctggagagggagggactcacagctgcagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaa

SEQ ID NO: 307017 - DNA, 2659 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (34)..(34): n is a, c, g, or t
accgtgcagtactntnacggtttanggtagcgangctgggtgggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagaggaggatcctgagcacagagtccgggtccgggtcaccaagctccgtctcggaggccctaatcaggatctgactgtcctcgagatgaaacgggaaaacccacagctgaaacaaatcgaggggctggtgaaggagctgctggagagggagggactcacagctgcagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaa

SEQ ID NO: 307018 - DNA, 2922 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (34)..(34): n is a, c, g, or t
accgtgcagtactntnacggtttanggtagcgangctgggtgggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtaggaccttgtttcacctgttccgtgaaactcacttccatttcttcccttcccctgatcttactgtcctgactgactggtggggtgggggggggtggaaaagtaccatgggccctcctcccttggtgatagaggaggggaagggaccccatcctatttgctcccttctgtctcacccctcctgtcagatcagtctctccctgttctctgtaccctaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagaggaggatcctgagcacagagtccgggtccgggtcaccaagctccgtctcggaggccctaatcaggatctgactgtcctcgagatgaaacgggaaaacccacagctgaaacaaatcgaggggctggtgaaggagctgctggagagggagggactcacagctgcagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaa

SEQ ID NO: 307019 - DNA, 2825 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (34)..(34): n is a, c, g, or t
accgtgcagtactntnacggtttanggtagcgangctgggtgggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccggtgagtaattagagaaggaggagaagacggggagatacgggggcagggggtggcaaaagatcaagtattgaatagctggaggaatgtgttcctggcctgcttgcatgctgtttctcagtagactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagaggaggatcctgagcacagagtccgggtccgggtcaccaagctccgtctcggaggccctaatcaggatctgactgtcctcgagatgaaacgggaaaacccacagctgaaacaaatcgaggggctggtgaaggagctgctggagagggagggactcacagctgcagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaa

SEQ ID NO: 307020 - DNA, 3762 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (34)..(34): n is a, c, g, or t
accgtgcagtactntnacggtttanggtagcgangctgggtgggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacaggtgagagcagtcagacaagaaagagtagcccagtctgttgttttcatccctcagctggttctgttcccagaggggaccctgttccttcccttctgagggtgctcattctctccccactttctggaacactgtcctcacttgcgcctgcttcccaacaccgtcatccctttgcgtgtttacctcctattcatctctctgggaagcagcttttagagcatatctgctggttttctggtttgctcctgtacacccagtgcctagcactctgcctggcacacaatggatgatcagtagctagtaattgaatgcttgtgagtctatatgctgaaaaccactttaggactttgcaccaagagaggccccagctgtcagggcatgaataggagagcccagctgcacatgagccaatagcttggatagactttaaattatttcttcttcttgtatccccttgtgtccatttcatagtgtcctatgggtgtggacatcagatattctaaatggaatgttccagtttcaaaccttccattcccactctctctataaacattgaaatgtctttaaagtcccaacatatggaggaggagaccacacttttccaacctgcttcttcaaacagaactttgttggtgcaggtggcctgattttggctttagaaaacatttgttttcctataggtgacgggcagaattattgggtagggcgggaagatggaaggctgcaattggtggagggagctctacaggctgaactgggaggggcggggcacacatttttttgagccctggctcatatacatgttgagatggaagagctgccaaagccaactgatgttttagggggagatgacccccacacccctaaccctggagtcacgcctctgctttgtgtttccctgtgtgtctccccctctaagaggaggatcctgagcacagagtccgggtccgggtcaccaagctccgtctcggaggccctaatcaggatctgactgtcctcgagatgaaacgggaaaacccacagctgaaacaaatcgaggggctggtgaaggagctgctggagagggagggactcacagctgcaggtgggccctggagggcggctggacccagtgctgtcggaagggcaagctgccggaagtggaggggctgggaccagtggggcagggggcctgccctgaggctcccaaccatcctctcctctcactgcatactgctcctttccagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaa

SEQ ID NO: 307021 - DNA, 3043 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (34)..(34): n is a, c, g, or t
accgtgcagtactntnacggtttanggtagcgangctgggtgggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccggtgagtaattagagaaggaggagaagacggggagatacgggggcagggggtggcaaaagatcaagtattgaatagctggaggaatgtgttcctggcctgcttgcatgctgtttctcagtagactcaaagcagtatggagataaaatcatagaggagctgcaagatctaggcccccaagtgtggagtgagaccaagtctggggtggcaccccaaaagatggcaggtaggaccttgtttcacctgttccgtgaaactcacttccatttcttcccttcccctgatcttactgtcctgactgactggtggggtgggggggggtggaaaagtaccatgggccctcctcccttggtgatagaggaggggaagggaccccatcctatttgctcccttctgtctcacccctcctgtcagatcagtctctccctgttctctgtaccctaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagaggaggatcctgagcacagagtccgggtccgggtcaccaagctccgtctcggaggccctaatcaggatctgactgtcctcgagatgaaacgggaaaacccacagctgaaacaaatcgaggggctggtgaaggagctgctggagagggagggactcacagctgcagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaa

SEQ ID NO: 307022 - DNA, 2494 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (34)..(34): n is a, c, g, or t
accgtgcagtactntnacggtttanggtagcgangctgggtgggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaa

SEQ ID NO: 307023 - DNA, 2432 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (34)..(34): n is a, c, g, or t
accgtgcagtactntnacggtttanggtagcgangctgggtgggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctgtgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaa

SEQ ID NO: 307024 - DNA, 2870 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (34)..(34): n is a, c, g, or t
accgtgcagtactntnacggtttanggtagcgangctgggtgggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagaggaggatcctgagcacagagtccgggtccgggtcaccaagctccgtctcggaggccctaatcaggatctgactgtcctcgagatgaaacgggaaaacccacagctgaaacaaatcgaggggctggtgaaggagctgctggagagggagggactcacagctgcagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaaaaaaaaaaaagaaaaaaaatttgtggggcgctcgcccgaaaattttcacacctcgtggggcggcccaagggagagaaatgcccacgggtccaagaacacggcagaaaggtggttccccaaaaagccgggccgcgttggacaccagggctggggtcggccaaaggcg

SEQ ID NO: 307025 - DNA, 2747 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (34)..(34): n is a, c, g, or t
  misc_feature (2712)..(2712): n is a, c, g, or t
  misc_feature (2715)..(2715): n is a, c, g, or t
accgtgcagtactntnacggtttanggtagcgangctgggtgggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagaggaggatcctgagcacagagtccgggtccgggtcaccaagctccgtctcggaggccctaatcaggatctgactgtcctcgagatgaaacgggaaaacccacagctgaaacaaatcgaggggctggtgaaggagctgctggagagggagggactcacagctgcagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaaaaaaaaanagncgacgcggccgcgaatttagtagtagtaggcg

SEQ ID NO: 307026 - DNA, 2673 bp, Homo sapiens
  misc_feature (33)..(33): n is a, c, g, or t
  misc_feature (47)..(47): n is a, c, g, or t
  misc_feature (81)..(81): n is a, c, g, or t
  misc_feature (125)..(125): n is a, c, g, or t
tgtgaggtatctagaggatcccggctcccactnggttgctagatctngcagctcctctatgatttatctccatactggttngagtcggcttgctctgaacgtaggccatgtactcctcaggctgnagggaagggtgacagaggatggctgcggtgcagcactgggtgggggccggaggagaggagacaatcaccacgtccgaagattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagaggaggatcctgagcacagagtccgggtccgggtcaccaagctccgtctcggaggccctaatcaggatctgactgtcctcgagatgaaacgggaaaacccacagctgaaacaaatcgaggggctggtgaaggagctgctggagagggagggactcacagctgcagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaa

SEQ ID NO: 307027 - DNA, 2940 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (34)..(34): n is a, c, g, or t
accgtgcagtactntnacggtttanggtagcgangctgggtgggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggtggcaagagtgtgggattcaggaagaaagggttctggccaccggctgagagccctgacaagaaggggagggtcaagattagctgatctgtttcttggggcttggtggccattaggacaaagtttcctggggcctgggggcacaggccattcttttgtctctttggggacgcagtgccatccttcctctttgctatctttctcatgtcccccattcctgcctcatgtcttctccaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagaggaggatcctgagcacagagtccgggtccgggtcaccaagctccgtctcggaggccctaatcaggatctgactgtcctcgagatgaaacgggaaaacccacagctgaaacaaatcgaggggctggtgaaggagctgctggagagggagggactcacagctgcagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaa

SEQ ID NO: 307028 - DNA, 2605 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (34)..(34): n is a, c, g, or t
accgtgcagtactntnacggtttanggtagcgangctgggtgggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaagttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagaggaggatcctgagcacagagtccgggtccgggtcaccaagctccgtctcggaggccctaatcaggatctgactgtcctcgagatgaaacgggaaaacccacagctgaaacaaatcgaggggctggtgaaggagctgctggagagggagggactcacagctgcagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaa

SEQ ID NO: 307029 - DNA, 2572 bp, Homo sapiens
gttggcctactggaaaaataaaaaaaaaaggagaaaaaaaaaaaaaaaaaaaaaaaaaaaaaaaaaaaaaaaaaaaaaaaggagggggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagaggaggatcctgagcacagagtccgggtccgggtcaccaagctccgtctcggaggccctaatcaggatctgactgtcctcgagatgaaacgggaaaacccacagctgaaacaaatcgaggggctggtgaaggagctgctggagagggagggactcacagctgcagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaa

SEQ ID NO: 307030 - DNA, 2283 bp, Homo sapiens
gttggcctactggaaaaataaaaaaaaaaggagaaaaaaaaaaaaaaaaaaaaaaaaaaaaaaaaaaaaaaaaaaaaaaaggagggggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagaggaggatcctgagcacagagtccgggtccgggtcaccaagctccgtctcggaggccctaatcaggatctgactgtcctcgagatgaaacgggaaaacccacagctgaaacaaatcgaggggctggtgaaggagctgctggagagggagggactcacagctgcagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaa

SEQ ID NO: 307031 - DNA, 3298 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (34)..(34): n is a, c, g, or t
accgtgcagtactntnacggtttanggtagcgangctgggtgggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagggaggaatggaaagaccacaagtggaaaacagactttagagatatctctccaagtcacagaaggaaagcagccctccctccttactgaaagtctggagaattgagagtggaagtgaagggaagagaattgagtgtgtaagtagatgagaggttatgtgtcttggagccaggagactctggttccaagaaaagatgtctgcactccatccccctgattgtttattttttaattgtcagacaaaggactggtggacatatgaattctgttatggacgccacatccagcaataccacatggaagattcagagatcaaaggtgaagtcctctatctcggctactaccaatcagccttcgactgggatgatgaaacagccaaggtggcaagagtgtgggattcaggaagaaagggttctggccaccggctgagagccctgacaagaaggggagggtcaagattagctgatctgtttcttggggcttggtggccattaggacaaagtttcctggggcctgggggcacaggccattcttttgtctctttggggacgcagtgccatccttcctctttgctatctttctcatgtcccccattcctgcctcatgtcttctccaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccggtgagtaattagagaaggaggagaagacggggagatacgggggcagggggtggcaaaagatcaagtattgaatagctggaggaatgtgttcctggcctgcttgcatgctgtttctcagtagactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagaggaggatcctgagcacagagtccgggtccgggtcaccaagctccgtctcggaggccctaatcaggatctgactgtcctcgagatgaaacgggaaaacccacagctgaaacaaatcgaggggctggtgaaggagctgctggagagggagggactcacagctgcagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaa

SEQ ID NO: 307032 - DNA, 2135 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (34)..(34): n is a, c, g, or t
accgtgcagtactntnacggtttanggtagcgangctgggtgggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagaggaggatcctgagcacagagtccgggtccgggtcaccaagctccgtctcggaggccctaatcaggatctgactgtcctcgagatgaaacgggaaaacccacagctgaaacaaatcgaggggctggtgaaggagctgctggagagggagggactcacagctgcagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgaccctccgtcactcgcgataccatatttccacgttcggggtttcctacagagaccagtatac

SEQ ID NO: 307033 - DNA, 2077 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (34)..(34): n is a, c, g, or t
accgtgcagtactntnacggtttanggtagcgangctgggtgggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagaggaggatcctgagcacagagtccgggtccgggtcaccaagctccgtctcggaggccctaatcaggatctgactgtcctcgagatgaaacgggaaaacccacagctgaaacaaatcgaggggctggtgaaggagctgctggagagggagggactcacagctgcagggaaaattgagatcaaaattgtccgcccatgggctgaagggactgaagaggtgatcttctagaagatcacctcatcgtgctggagagggtgtgggttgaaatgttaaatataatgatcagggtaaacttcattgagaaggtgataatcaaggaaagatctggagttggtaagagaatggccttgtggatttctgagaaaagaaatagcaaggatgccagtgtggttggatatgggcaggggtcaagtagaaggagggagg

SEQ ID NO: 307034 - DNA, 1774 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (34)..(34): n is a, c, g, or t
  misc_feature (1753)..(1753): n is a, c, g, or t
  misc_feature (1760)..(1760): n is a, c, g, or t
accgtgcagtactntnacggtttanggtagcgangctgggtgggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagaggaggatcctgagcacagagtccgggtccgggtcaccaagctccgtctcggaggccctaatcaggatctgactgtcctcgagatgaaacgggtgacggtnccgagtnagggatcctctaga

SEQ ID NO: 307035 - DNA, 1870 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (34)..(34): n is a, c, g, or t
accgtgcagtactntnacggtttanggtagcgangctgggtgggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcttaggccagaaaagagccatctcaaatagaagagtgaatggaagatataaaggaggttaaatttctgtacaattataatgaccttcatgatgactgcaatccaacatgtaagaataagtattaactaataaacatggttgtatgcaggggaatgcatagtgtgagggggttatgtacccaggcccatatatgttatgcgttacagttagaaggaatgacatatgtccacttaaacaaggggg

SEQ ID NO: 307036 - DNA, 1429 bp, Homo sapiens
cgcgcggccccctccagcaaaggtaagttcacatcctggaaacagtaaatgtgaccttacttaggaaaaggacttttgcagatataattaaattaaagatctcaagatgggagagcatcctggattatccaggtggagtgaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagaggaggatcctgagcacagagtccgggtccgggtcaccaagctccgtctcggaggccctaatcaggatctgactgtcctcgagatgaaacgggaaaacccacagctgaaacaaatcgaggggctggtgaaggagctgctggagagggagggactcacagctgcagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaa

SEQ ID NO: 307037 - DNA, 1576 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (34)..(34): n is a, c, g, or t
accgtgcagtactntnacggtttanggtagcgangctgggtgggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacataaggcaggttgtctggccaatcttgctcccattcacctcgattgctttagcccactggattgcggcttaagaccttggggatcctctaatgcag

SEQ ID NO: 307038 - DNA, 1454 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (34)..(34): n is a, c, g, or t
accgtgcagtactntnacggtttanggtagcgangctgggtgggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaactgaaacggattgccagagaattggcagaagatgacagcatattaaagtgagtgaccctgcgacccactctttggaccagcagcggatgaataaagcttcctgtgttgtgtgata

SEQ ID NO: 307039 - DNA, 1196 bp, Homo sapiens
gacttgctgccgagcgaccatctacctggagcgctacagcgcttcctgcgtgaggccagagccccgatgagcctaccccatgtctgtgctctggtgtgcaaagtccaacggtgagagccaagaagggttgtccccagtcccccagtaccactaaagaggatcctgaccatccggtcgtcaccaagctccgtctcggaggccctaatcaggatctgactgtcctcgagatgaaacgggaaaacccacagctgaaacaaatcgaggggctggtgaaggagctgctggagagggagggactcacagctgcagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaa

SEQ ID NO: 307040 - DNA, 1194 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (34)..(34): n is a, c, g, or t
accgtgcagtactntnacggtttanggtagcgangctgggtgggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgagttttgtcaattattcgataatggcccatctggccataacgctatatatgtggtaccgctcgaccagcgttcaagatgcgctttgtcaattcgtccacctctcccagccaccacacccaacacagctctgttgcctgaggagatactact

SEQ ID NO: 307041 - DNA, 1161 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (34)..(34): n is a, c, g, or t
accgtgcagtactntnacggtttanggtagcgangctgggtgggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaa

SEQ ID NO: 307042 - DNA, 739 bp, Homo sapiens
gttggcctactggaaaaataaaaaaaaaaggagaaaaaaaaaaaaaaaaaaaaaaaaaaaaaaaaaaaaaaaaaaaaaaaggagggggaacgaaagatggcggcggaaacgctgctgtccagtttgttaggactgctgcttctgggactcctgttacccgcaagtctgaccggcggtgtcgggagcctgaacctggaggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaa

SEQ ID NO: 307043 - DNA, 847 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (34)..(34): n is a, c, g, or t
accgtgcagtactntnacggtttanggtagcgangctgggtgggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccccgggttccggggccctcggaccttcctaggcggggagaaggccagaagggagagcgaaatatgagggaagagagggagggaaaaacc

SEQ ID NO: 307044 - DNA, 816 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (34)..(34): n is a, c, g, or t
accgtgcagtactntnacggtttanggtagcgangctgggtgggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggtccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaa

SEQ ID NO: 307045 - DNA, 319 bp, Homo sapiens
tggctgactgatgaggacacgagaaacctcaaggagatcttcttcaatatcttggtaagaggcttctacccccgagtcctggcccccagccctcctggagtggaggtgcgggcttgccccagccacgccattgctgagcttccatttcctgatctgtaagacaaggctggggttccagtggctcagagtgctgccatgcaggaagagcccctcaggacatgggtgtcctcattccctgccttcccccagctgcctggcccaggacttccctgggctcaacggccagtagctccagcccacctctaccctctcccaccag

SEQ ID NO: 307046 - DNA, 395 bp, Homo sapiens
cctgggggtcgcagactgagaccaattctctgggggccaggaattgggagaggtggggcttcccgctgtcaaccttcaggtctcagtttatgatcgaaacacccggactccgcccccgtggagaaatgggagcgccctctcctctcacccactaaatacagctggagggcttatggcttattctgtcttcgactgatctcttccccagggtttgaagagggatttcgttgttctccctgatcccagcctttctttgcttccttgccccccgaccctcccttctttcccagagccaatcttcggacgtggtgattgtctcctctaagtacaaacagcgctatgagtgtcgcctgccagctggagctattcacttccagcgtgaaagggaggaggaa

SEQ ID NO: 307047 - DNA, 422 bp, Homo sapiens
tatgtgtcttggagccaggagactctggttccaagaaaagatgtctgcactccatccccctgattgtttattttttaattgtcagacaaaggactggtggacatatgaattctgttatggacgccacatccagcaataccacatggaaggtaactcactcctatattttccttaagcccttagtgtcatatcatggaagttccccagttccctcctcctcctcctcctcttaagagtaacagtgcttcactgtggcttcccttgcagattcagagatcaaaggtgaagtcctctatctcggctactaccaatcagccttcgactgggatgatgaaacagccaaggtggcaagagtgtgggattcaggaagaaagggttctggccaccggctgagagccctgacaagaaggggagggtcaaga

SEQ ID NO: 307048 - DNA, 970 bp, Homo sapiens
aacatactgagttaacacattttcctagtagtgatagaattttcagggaagcaagaaaccaagaaaattctggctgctacctaattttaatgaagtggcgattatctgcccacaaggtatgagaagtatagatgtgcattgctctacaaatatacaacgcaataaggcccactcgaaattcatgaaaggcttgccaagccacatggcttgattggtcgtaggtagatgcatgatgtccctcttagaatgaggcccatgtttaaaatccacatttacaaaaggagtaggtacaattgtgatgttttgaggtaaccaaagtgtgtcatgaaaaagaacgtcaagaagaaaggcagaggaactcatgagtttgaatggttaaactgaaggcaagaaaaagtcctaagaataaaactgaaaaatattttaatatgcctatgtatctttcacagagtggattcaactgcacataagaagaacataatgttgaagtcatttcagagtgcaaatatcattgaattgcttcattatcaccagtgtgactctcgatcatcaacaaaagcagaaattctgaaatgtttgctaaacctgcaaattcagcatattgatgccaggtttgctgtcctcctaacaggtaattcacaggcgcattttactcagttaatgccaaaattggtcagctctaggaatgtcaaagttagatacctgatgaagagtatcaggtatctaaatggcttggcatcccatggataccagaatcacccaaatctgctgaagctgaagcccttatataaaatgtagtatttgcaggtaactacacaatcctcctatgtatgtaagtcagttctagattacttataatactcaatacagtataagtagttataccgtattattttttaaatcaatactggggctgggtgcagtggctcacacctgtaatcccagcactttgggaggccgaggcgggcgg

SEQ ID NO: 307049 - DNA, 151 bp, Homo sapiens
tatgatgtcataaaaaatttatacaggaaaaagtgaaaggaaattaattcatgatgttaagagtgattatcactagggttatgggaatgggtgtgatttgggttttctccaacaagcatgagaatgtaagtgatgaaaactagagagacgg

SEQ ID NO: 307050 - DNA, 5199 bp, Homo sapiens
gtatatccctcagtgtcagaagaaccagtagaaaataaggagagaaagggggataatttacaaccagttactttaatactttctaaagaaaattgcacccttgagattgcagaggaaattaatgtgacctctgattttccctttgattctgtaattgaagaagtatcaccagcgtctagtcctgaacctccagtaccagttaaagagacacgaccatatcaggctgtgactccatgcattttaaaacttcatggtacacagtgtgagaagagcaaccaaatctcccaatgtgagtcagaagacttaggcataacagaaaaagaaaatgtttttgttggtcctacccatccagtggggcaagataactttacccaggtacaacaaatgcaggtctctgccgaaatgcctctaatattaactgatcatccaggaagaacaggtagaccaacccttcctggtaaagtaactgaggaaattgtctcaagtgagcatgatgagggtttatctttctcaggaaaggtgcagtgctatggtagggagttaaaccagcctgcctcagctgccaaatgcacaggtgacttcagtccttctcctgaaaaactggtaaaatcaggaaatccattgcagccagttagtatagagaatagaaatttggacttaaaacatcttgtcttggagtccagtgaacctccatttggtcctagaaatgttattgaaaataagtctttgtctgacacattggtttccacaactgcaccaagtggtatagtgaatgtgtcagtaaaacagcagactagccctaaaagcagtcagaaccatctctttcccggtgatttgaaaacagatgaaggcatttatctgcaggtgaagtccttgacagctgcctcggttgatggagcttattctacacagggatgcatgtgctcagtggtccccacgctttgttcttcctcagacaatgctacattaacccattatgtaagaccaataaatgcagagccagcgtttcaagcacaggaaataccagcaggcagaatggccagtttgcttaagaatggtgagcctgaagctgagttacataaagaaaccacaggtccaggcactgctggccctcagtccaacaccacatcttctctaaaaggtgaacgcaaagccatccacacgctgcaagatgtgtcaacatgtgaaacaaaggagctattgaatgtcggggtttcctccctttgtgctggtccctaccaaaatacagcagacaccaaggaaaacctcagtaaagagcctttggcctcctttgtttcagaatcctttgatacttctgtttgtggaatagccacagagcacgtagaaattgagaacagtggggaggggctcagggctgaggctggttctgaaaccctaggcagagatggagaggtcggtgtgaattccgacatgcactatgaactctctggagattctgatctagacctgcttggtgattgtagaaatcccagactggatttggaggattcttatactttaagaggtagttacaccaggaaaaaagatgttcccacagatggctatgagtcgtcgttgaacttccacaacaacaaccaagaggactggggctgctctagctgggttccaggcatggagacgagcctccctcccgggcactggactgctgcggtaaagaaagaagagaagtgtgtgccgccttacgtccaaatccgagatctccacgggatcctcaggacttacgccaacttctctataacaaaagaactcaaagataccatgagaacttcacacggcctgaggaggcacccgagtttcagtgcaaactgtggcctgcccagctcctggacaagcacttggcaggtggcagacgacctcacccagaacactttagacctggagtatctgcgttttgcacataaactaaaacagaccataaagaatggggattctcagcattctgcctcctctgccaatgtctttccaaaggagtcaccaacccagatctccattggtgctttcccttcgacaaaaatctctgaggccccatttctgcatcctgcacctaggagcagaagcccccttctggtaacagttgtggagtcagatcccagaccacaggggcagcccaggagaggctacacagccagcagtctggacagctcttcctcttggagagagagatgtagtcataatagagatcttagaaattctcaaagaaatcacactgtttcattccacctcaacaaactgaaatacaacagtactgtgaaggaatctcggaatgatatttcacttattctcaatgagtatgctgaattcaacaaggtgatgaagaatagcaaccaattcattttccaagacaaagagctaaatgatgtttctggagaagccactgctcaagagatgtatctgcctttcccaggacggtcagcctcctatgaagacataatcatagacgtgtgcaccaatttgcacgtcaaactaagaagtgttgtgaaagaggcttgtaaaagtaccttcctgttctaccttgtcgaaacagaagacaaatcattctttgtaagaacaaagaaccttctgaggaaaggaggccatacagaaattgaacctcagcacttctgtcaagctttccacagagagaatgatacactaatcatcatcatcagaaatgaagatatatcatcacatttgcatcagattccttctttgctgaagctgaagcatttccccagtgtcatctttgctggagtagacagccctggagatgttcttgatcacacctaccaagaactgtttcgtgcaggaggctttgtgatatcagatgacaagatactagaagctgtaacattagttcaactgaaggaaattatcaaaatcctggaaaaactaaatggaaatggaagatggaagtggttgcttcactacagggaaaataaaaagctaaaagaagatgaaagagtggattcaactgcacataagaagaacataatgttgaagtcatttcagagtgcaaatatcattgaattgcttcattatcaccagtgtgactctcgatcatcaacaaaagcagaaattctgaaatgtttgctaaacctgcaaattcagcatattgatgccaggtttgctgtcctcctaacagacaagcctactatccccagagaagtctttgaaaataatggaatccttgttacagatgtaaataactttatagaaaacatagaaaaaatagcagctccatttaggagtagctattggtgactcaactacagcctgcctggatatggatgatgccaataaaaaattagtattttccctttggaaaacttgtgaacatgtgaatacacatgtgaacagtcttacatttgaaaaaccaatgttctacaacttggaaagttttcattttttatattttgctgaaatatgtcacagtggcattgcagttgtctgttagctttgggttgcagtgctagatattgttttaaattattttcattttaaacaagatgccttctaagctattgagcttattaaaaataattttacatgtttacttagttggagcaaaaataagtctattttaacaaatagctttgtttttgcatgctaatgtcagaaaggcatacgatgcacattatgctctgttttaaaggttttaccacccttgtaaaaactataatcttaaatggttttatttgctgttacacaaacaacactacataaaacattttttcctaaatggtacaaatttataaactatcatttttcacttacggtatttgtaaatactacactacaaaaatcagctttctgagaaagaaataatcatttatttatgatattgaaaatttctacagtaaacactcaaaaccaagcaaaaaacatttgtaagatacacggtatctatttggagcaacggtttttgtaactaatgtgtttcattttttaaataaagacaactaaaaataaatctctttctgcaatgatttttatagcagaaattgacttatctggagtgttctagcaatttttaggtcatttagcagaacagtaagcttccagaggaaacctacacttctatcctttgggcctggcctgttctgtttctgggttctttccgcagtcaagtacaccgagtaacaggttaaagaatggcagtttcacctggcctttacagggacacttacttctttcagaagtcattaagtcggcttttattattcctaaacaaaagagctttattttctcatgagtaggttttagagttttaattgttgacaatttttcagttactaatagaaccccagtcatttcattttatttttccaaggacaagagtctattaagggaaccattaactattcagtacagtgaattactttcagattactaaggaaaaggaaagtgagcagttataagatgccaaacacctatctatctgcctgaaatatgcacctttcaggttggacctaataacattcacctccccttgctgaaaagccttccaacacccacgaggccatctcagtttccatgctaccttttctgtaactctactaataaccaaaccacatcatgtgttcaccaaactgagttatcccagtaactaccattatcatctttgtctccactggcctggcacacaaggtattcagtaaatacgttgaatgaagaatatgaagatgcgtggtttttcttttttcacttattactaacccagcttgggcctttgcatgggaagagaaaaaggcttgctgggacttcagataattttatcatacaggtaaagcagtggttctcaacatctggagacatttttggttgtcattccaagatggtgctgttgccatctagtgtgtggaggccagggatgctgctacaatcaaccctatcaacagagaatgatccagcccaaaacatcaactgaagtcgagaagctccatcattttggcaatatgaataacaatctaaatcaccaccctagttcctttaacacatcatctaccttagtctgtctccttcatactctgaagagtcagtgtttatctgtggtaaacaacagcatctgccgtgaggctcatcactgtcaggggaaagggccttatatgtaaacactttatcatttcaactacacaaaaattatttactaaagcacctactctacctgacagttcacttactcccttataactgctgcta

SEQ ID NO: 307051 - DNA, 4777 bp, Homo sapiens
gtatatccctcagtgtcagaagaaccagtagaaaataaggagagaaagggggataatttacaaccagttactttaatactttctaaagaaaattgcacccttgagattgcagaggaaattaatgtgacctctgattttccctttgattctgtaattgaagaagtatcaccagcgtctagtcctgaacctccagtaccagttaaagagacacgaccatatcaggctgtgactccatgcattttaaaacttcatggtacacagtgtgagaagagcaaccaaatctcccaatgtgagtcagaagacttaggcataacagaaaaagaaaatgtttttgttggtcctacccatccagtggggcaagataactttacccaggtacaacaaatgcaggtctctgccgaaatgcctctaatattaactgatcatccaggaagaacaggtagaccaacccttcctggtaaagtaactgaggaaattgtctcaagtgagcatgatgagggtttatctttctcaggaaaggtgcagtgctatggtagggagttaaaccagcctgcctcagctgccaaatgcacaggtgacttcagtccttctcctgaaaaactggtaaaatcaggaaatccattgcagccagttagtatagagaatagaaatttggacttaaaacatcttgtcttggagtccagtgaacctccatttggtcctagaaatgttattgaaaataagtctttgtctgacacattggtttccacaactgcaccaagtggtatagtgaatgtgtcagtaaaacagcagactagccctaaaagcagtcagaaccatctctttcccggtgatttgaaaacagatgaaggcatttatctgcaggtgaagtccttgacagctgcctcggttgatggagcttattctacacagggatgcatgtgctcagtggtccccacgctttgttcttcctcagacaatgctacattaacccattatgtaagaccaataaatgcagagccagcgtttcaagcacaggaaataccagcaggcagaatggccagtttgcttaagaatggtgagcctgaagctgagttacataaagaaaccacaggtccaggcactgctggccctcagtccaacaccacatcttctctaaaaggtgaacgcaaagccatccacacgctgcaagatgtgtcaacatgtgaaacaaaggagctattgaatgtcggggtttcctccctttgtgctggtccctaccaaaatacagcagacaccaaggaaaacctcagtaaagagcctttggcctcctttgtttcagaatcctttgatacttctgtttgtggaatagccacagagcacgtagaaattgagaacagtggggaggggctcagggctgaggctggttctgaaaccctaggcagagatggagaggtcggtgtgaattccgacatgcactatgaactctctggagattctgatctagacctgcttggtgattgtagaaatcccagactggatttggaggattcttatactttaagaggtagttacaccaggaaaaaagatgttcccacagatggctatgagtcgtcgttgaacttccacaacaacaaccaagaggactggggctgctctagctgggttccaggcatggagacgagcctccctcccgggcactggactgctgcggtaaagaaagaagagaagtgtgtgccgccttacgtccaaatccgagatctccacgggatcctcaggacttacgccaacttctctataacaaaagaactcaaagataccatgagaacttcacacggcctgaggaggcacccgagtttcagtgcaaactgtggcctgcccagctcctggacaagcacttggcaggtggcagacgacctcacccagaacactttagacctggagtatctgcgttttgcacataaactaaaacagaccataaagaatggggattctcagcattctgcctcctctgccaatgtctttccaaaggagtcaccaacccagatctccattggtgctttcccttcgacaaaaatctctgaggccccatttctgcatcctgcacctaggagcagaagcccccttctggtaacagttgtggagtcagatcccagaccacaggggcagcccaggagaggctacacagccagcagtctggacagctcttcctcttggagagagagatgtagtcataatagagatcttagaaattctcaaagaaatcacactgtttcattccacctcaacaaactgaaatacaacagtactgtgaaggaatctcggaatgatatttcacttattctcaatgagtatgctgaattcaacaaggtgatgaagaatagcaaccaattcattttccaagacaaagagctaaatgatgtttctggagaagccactgctcaagagatgtatctgcctttcccaggacggtcagcctcctatgaagacataatcatagacgtgtgcaccaatttgcacgtcaaactaagaagtgttgtgaaagaggcttgtaaaagtaccttcctgttctaccttgtcgaaacagaagacaaatcattctttgtaagaacaaagaaccttctgaggaaaggaggccatacagaaattgaacctcagcacttctgtcaagctttccacagagagaatgatacactaatcatcatcatcagaaatgaagatatatcatcacatttgcatcagattccttctttgctgaagctgaagcatttccccagtgtcatctttgctggagtagacagccctggagatgttcttgatcacacctaccaagaactgtttcgtgcaggaggctttgtgatatcagatgacaagatactagaagctgtaacattagttcaactgaaggaaattatcaaaatcctggaaaaactaaatggaaatggaagatggaagtggttgcttcactacagggaaaataaaaagctaaaagaagatgaaagagtggattcaactgcacataagaagaacataatgttgaagtcatttcagagtgcaaatatcattgaattgcttcattatcaccagtgtgactctcgatcatcaacaaaagcagaaattctgaaatgtttgctaaacctgcaaattcagcatattgatgccaggtttgctgtcctcctaacagacaagcctactatccccagagaagtctttgaaaataatggaatccttgttacagatgtaaataactttatagaaaacatagaaaaaatagcagctccatttaggagtagctattggtgactcaactacagcctgcctggatatggatgatgccaataaaaaattagtattttccctttggaaaacttgtgaacatgtgaatacacatgtgaacagtcttacatttgaaaaaccaatgttctacaacttggaaagttttcattttttatattttgctgaaatatgtcacagtggcattgcagttgtctgttagctttgggttgcagtgctagatattgttttaaattattttcattttaaacaagatgccttctaagctattgagcttattaaaaataattttacatgtttacttagttggagcaaaaataagtctattttaacaaatagctttgtttttgcatgctaatgtcagaaaggcatacgatgcacattatgctctgttttaaaggttttaccacccttgtaaaaactataatcttaaatggttttatttgctgttacacaaacaacactacataaaacattttttcctaaatggtacaaatttataaactatcatttttcacttacggtatttgtaaatactacactacaaaaatcagctttctgagaaagaaataatcatttatttatgatattgaaaatttctacagtaaacactcaaaaccaagcaaaaaacatttgtaagatacacggtatctatttggagcaacggtttttgtaactaatgtgtttcattttttaaataaagacaactaaaaataaatctctttctgcaatgatttttatagcagaaattgacttatctggagtgttctagcaatttttaggtcatttagcagaacagtaagcttccagaggaaacctacacttctatcctttgggcctggcctgttctgtttctgggttctttccgcagtcaagtacaccgagtaacaggttaaagaatggcagtttcacctggcctttacagggacacttacttctttcagaagtcattaagtcggcttttattattcctaaacaaaagagctttattttctcatgagtaggttttagagttttaattgttgacaatttttcagttactaatagaaccccagtcatttcattttatttttccaaggacaagagtctattaagggaaccattaactattcagtacagtgaattactttcagattactaaggaaaaggaaagtgagcagttataagatgccaaacacctatctatctgcctgaaatatgcacctttcaggttggacctaataacattcacctccccttgctgaaaagccttccaacacccacgaggccatctcagtttccatgctaccttttctgtaactctactaataaccaaaccacatcatgtgttcaccaaactgagttatcccagtaactaccattatcatctttgtctccactggcctggcacacaaggtattcagtaaatacgttgaatgaagaatatgaagatgcgtggtttttcttttttcacttattactaacccagcaagcctttttctcttcccatgcaaaggcccaagctgggttagtaataagtgaaaaa

SEQ ID NO: 307052 - DNA, 5145 bp, Homo sapiens
gtatatccctcagtgtcagaagaaccagtagaaaataaggagagaaagggggataatttacaaccagttactttaatactttctaaagaaaattgcacccttgagattgcagaggaaattaatgtgacctctgattttccctttgattctgtaattgaagaagtatcaccagcgtctagtcctgaacctccagtaccagttaaagagacacgaccatatcaggctgtgactccatgcattttaaaacttcatggtacacagtgtgagaagagcaaccaaatctcccaatgtgagtcagaagacttaggcataacagaaaaagaaaatgtttttgttggtcctacccatccagtggggcaagataactttacccaggtacaacaaatgcaggtctctgccgaaatgcctctaatattaactgatcatccaggaagaacaggtagaccaacccttcctggtaaagtaactgaggaaattgtctcaagtgagcatgatgagggtttatctttctcaggaaaggtgcagtgctatggtagggagttaaaccagcctgcctcagctgccaaatgcacaggtgacttcagtccttctcctgaaaaactggtaaaatcaggaaatccattgcagccagttagtatagagaatagaaatttggacttaaaacatcttgtcttggagtccagtgaacctccatttggtcctagaaatgttattgaaaataagtctttgtctgacacattggtttccacaactgcaccaagtggtatagtgaatgtgtcagtaaaacagcagactagccctaaaagcagtcagaaccatctctttcccggtgatttgaaaacagatgaaggcatttatctgcaggtgaagtccttgacagctgcctcggttgatggagcttattctacacagggatgcatgtgctcagtggtccccacgctttgttcttcctcagacaatgctacattaacccattatgtaagaccaataaatgcagagccagcgtttcaagcacaggaaataccagcaggcagaatggccagtttgcttaagaatggtgagcctgaagctgagttacataaagaaaccacaggtccaggcactgctggccctcagtccaacaccacatcttctctaaaaggtgaacgcaaagccatccacacgctgcaagatgtgtcaacatgtgaaacaaaggagctattgaatgtcggggtttcctccctttgtgctggtccctaccaaaatacagcagacaccaaggaaaacctcagtaaagagcctttggcctcctttgtttcagaatcctttgatacttctgtttgtggaatagccacagagcacgtagaaattgagaacagtggggaggggctcagggctgaggctggttctgaaaccctaggcagagatggagaggtcggtgtgaattccgacatgcactatgaactctctggagattctgatctagacctgcttggtgattgtagaaatcccagactggatttggaggattcttatactttaagaggtagttacaccaggaaaaaagatgttcccacagatggctatgagtcgtcgttgaacttccacaacaacaaccaagaggactggggctgctctagctgggttccaggcatggagacgagcctccctcccgggcactggactgctgcggtaaagaaagaagagaagtgtgtgccgccttacgtccaaatccgagatctccacgggatcctcaggacttacgccaacttctctataactttcagtgcaaactgtggcctgcccagctcctggacaagcacttggcaggtggcagacgacctcacccagaacactttagacctggagtatctgcgttttgcacataaactaaaacagaccataaagaatggggattctcagcattctgcctcctctgccaatgtctttccaaaggagtcaccaacccagatctccattggtgctttcccttcgacaaaaatctctgaggccccatttctgcatcctgcacctaggagcagaagcccccttctggtaacagttgtggagtcagatcccagaccacaggggcagcccaggagaggctacacagccagcagtctggacagctcttcctcttggagagagagatgtagtcataatagagatcttagaaattctcaaagaaatcacactgtttcattccacctcaacaaactgaaatacaacagtactgtgaaggaatctcggaatgatatttcacttattctcaatgagtatgctgaattcaacaaggtgatgaagaatagcaaccaattcattttccaagacaaagagctaaatgatgtttctggagaagccactgctcaagagatgtatctgcctttcccaggacggtcagcctcctatgaagacataatcatagacgtgtgcaccaatttgcacgtcaaactaagaagtgttgtgaaagaggcttgtaaaagtaccttcctgttctaccttgtcgaaacagaagacaaatcattctttgtaagaacaaagaaccttctgaggaaaggaggccatacagaaattgaacctcagcacttctgtcaagctttccacagagagaatgatacactaatcatcatcatcagaaatgaagatatatcatcacatttgcatcagattccttctttgctgaagctgaagcatttccccagtgtcatctttgctggagtagacagccctggagatgttcttgatcacacctaccaagaactgtttcgtgcaggaggctttgtgatatcagatgacaagatactagaagctgtaacattagttcaactgaaggaaattatcaaaatcctggaaaaactaaatggaaatggaagatggaagtggttgcttcactacagggaaaataaaaagctaaaagaagatgaaagagtggattcaactgcacataagaagaacataatgttgaagtcatttcagagtgcaaatatcattgaattgcttcattatcaccagtgtgactctcgatcatcaacaaaagcagaaattctgaaatgtttgctaaacctgcaaattcagcatattgatgccaggtttgctgtcctcctaacagacaagcctactatccccagagaagtctttgaaaataatggaatccttgttacagatgtaaataactttatagaaaacatagaaaaaatagcagctccatttaggagtagctattggtgactcaactacagcctgcctggatatggatgatgccaataaaaaattagtattttccctttggaaaacttgtgaacatgtgaatacacatgtgaacagtcttacatttgaaaaaccaatgttctacaacttggaaagttttcattttttatattttgctgaaatatgtcacagtggcattgcagttgtctgttagctttgggttgcagtgctagatattgttttaaattattttcattttaaacaagatgccttctaagctattgagcttattaaaaataattttacatgtttacttagttggagcaaaaataagtctattttaacaaatagctttgtttttgcatgctaatgtcagaaaggcatacgatgcacattatgctctgttttaaaggttttaccacccttgtaaaaactataatcttaaatggttttatttgctgttacacaaacaacactacataaaacattttttcctaaatggtacaaatttataaactatcatttttcacttacggtatttgtaaatactacactacaaaaatcagctttctgagaaagaaataatcatttatttatgatattgaaaatttctacagtaaacactcaaaaccaagcaaaaaacatttgtaagatacacggtatctatttggagcaacggtttttgtaactaatgtgtttcattttttaaataaagacaactaaaaataaatctctttctgcaatgatttttatagcagaaattgacttatctggagtgttctagcaatttttaggtcatttagcagaacagtaagcttccagaggaaacctacacttctatcctttgggcctggcctgttctgtttctgggttctttccgcagtcaagtacaccgagtaacaggttaaagaatggcagtttcacctggcctttacagggacacttacttctttcagaagtcattaagtcggcttttattattcctaaacaaaagagctttattttctcatgagtaggttttagagttttaattgttgacaatttttcagttactaatagaaccccagtcatttcattttatttttccaaggacaagagtctattaagggaaccattaactattcagtacagtgaattactttcagattactaaggaaaaggaaagtgagcagttataagatgccaaacacctatctatctgcctgaaatatgcacctttcaggttggacctaataacattcacctccccttgctgaaaagccttccaacacccacgaggccatctcagtttccatgctaccttttctgtaactctactaataaccaaaccacatcatgtgttcaccaaactgagttatcccagtaactaccattatcatctttgtctccactggcctggcacacaaggtattcagtaaatacgttgaatgaagaatatgaagatgcgtggtttttcttttttcacttattactaacccagcttgggcctttgcatgggaagagaaaaaggcttgctgggacttcagataattttatcatacaggtaaagcagtggttctcaacatctggagacatttttggttgtcattccaagatggtgctgttgccatctagtgtgtggaggccagggatgctgctacaatcaaccctatcaacagagaatgatccagcccaaaacatcaactgaagtcgagaagctccatcattttggcaatatgaataacaatctaaatcaccaccctagttcctttaacacatcatctaccttagtctgtctccttcatactctgaagagtcagtgtttatctgtggtaaacaacagcatctgccgtgaggctcatcactgtcaggggaaagggccttatatgtaaacactttatcatttcaactacacaaaaattatttactaaagcacctactctacctgacagttcacttactcccttataactgctgcta

SEQ ID NO: 307053 - DNA, 5581 bp, Homo sapiens
gtatatccctcagtgtcagaagaaccagtagaaaataaggagagaaagggggataatttacaaccagttactttaatactttctaaagaaaattgcacccttgagattgcagaggaaattaatgtgacctctgattttccctttgattctgtaattgaagaagtatcaccagcgtctagtcctgaacctccagtaccagttaaagagacacgaccatatcaggctgtgactccatgcattttaaaacttcatggtacacagtgtgagaagagcaaccaaatctcccaatgtgagtcagaagacttaggcataacagaaaaagaaaatgtttttgttggtcctacccatccagtggggcaagataactttacccaggtacaacaaatgcaggtctctgccgaaatgcctctaatattaactgatcatccaggaagaacaggtagaccaacccttcctggtaaagtaactgaggaaattgtctcaagtgagcatgatgagggtttatctttctcaggaaaggtgcagtgctatggtagggagttaaaccagcctgcctcagctgccaaatgcacaggtgacttcagtccttctcctgaaaaactggtaaaatcaggaaatccattgcagccagttagtatagagaatagaaatttggacttaaaacatcttgtcttggagtccagtgaacctccatttggtcctagaaatgttattgaaaataagtctttgtctgacacattggtttccacaactgcaccaagtggtatagtgaatgtgtcagtaaaacagcagactagccctaaaagcagtcagaaccatctctttcccggtgatttgaaaacagatgaaggcatttatctgcaggtgaagtccttgacagctgcctcggttgatggagcttattctacacagggatgcatgtgctcagtggtccccacgctttgttcttcctcagacaatgctacattaacccattatgtaagaccaataaatgcagagccagcgtttcaagcacaggaaataccagcaggcagaatggccagtttgcttaagaatggtgagcctgaagctgagttacataaagaaaccacaggtccaggcactgctggccctcagtccaacaccacatcttctctaaaaggtgaacgcaaagccatccacacgctgcaagatgtgtcaacatgtgaaacaaaggagctattgaatgtcggggtttcctccctttgtgctggtccctaccaaaatacagcagacaccaaggaaaacctcagtaaagagcctttggcctcctttgtttcagaatcctttgatacttctgtttgtggaatagccacagagcacgtagaaattgagaacagtggggaggggctcagggctgaggctggttctgaaaccctaggcagagatggagaggtcggtgtgaattccgacatgcactatgaactctctggagattctgatctagacctgcttggtgattgtagaaatcccagactggatttggaggattcttatactttaagaggtagttacaccaggaaaaaagatgttcccacagatggctatgagtcgtcgttgaacttccacaacaacaaccaagaggactggggctgctctagctgggttccaggcatggagacgagcctccctcccgggcactggactgctgcggtaaagaaagaagagaagtgtgtgccgccttacgtccaaatccgagatctccacgggatcctcaggacttacgccaacttctctataacaaaagaactcaaagataccatgagaacttcacacggcctgaggaggcacccgagtttcagtgcaaactgtggcctgcccagctcctggacaagcacttggcaggtggcagacgacctcacccagaacactttagacctggagtatctgcgttttgcacataaactaaaacagaccataaagaatggggattctcagcattctgcctcctctgccaatgtctttccaaaggagtcaccaacccagatctccattggtgctttcccttcgacaaaaatctctgaggccccatttctgcatcctgcacctaggagcagaagcccccttctggtaacagttgtggagtcagatcccagaccacaggggcagcccaggagaggctacacagccagcagtctggacagctcttcctcttggagagagagatgtagtcataatagagatcttagaaattctcaaagaaatcacactgtttcattccacctcaacaaactgaaatacaacagtactgtgaaggaatctcggaatgatatttcacttattctcaatgagtatgctgaattcaacaaggtgatgaagaatagcaaccaattcattttccaagacaaagagctaaatgatgtttctggagaagccactgctcaagagatgtatctgcctttcccaggacggtcagcctcctatgaagacataatcatagacgtgtgcaccaatttgcacgtcaaactaagaagtgttgtgaaagaggcttgtaaaagtaccttcctgttctaccttgtcgaaacagaagacaaatcattctttgtaagaacaaagaaccttctgaggaaaggaggccatacagaaattgaacctcagcacttctgtcaagctttccacagagagaatgatacactaatcatcatcatcagaaatgaagatatatcatcacatttgcatcagattccttctttgctgaagctgaagcatttccccagtgtcatctttgctggagtagacagccctggagatgttcttgatcacacctaccaagaactgtttcgtgcaggaggctttgtgatatcagatgacaagatactagaagctgtaacattagttcaactgaaggaaattatcaaaatcctggaaaaactaaatggaaatggaagatggaagtggttgcttcactacagggaaaataaaaagctaaaagaagatgaaagagtggattcaactgcacataagaagaacataatgttgaagtcatttcagagtgcaaatatcattgaattgcttcattatcaccagtgtgactctcgatcatcaacaaaagcagaaattctgaaatgtttgctaaacctgcaaattcagcatattgatgccaggtttgctgtcctcctaacagacaagcctactatccccagagaagtctttgaaaataatggaatccttgttacagatgtaaataactttatagaaaacatagaaaaaatagcagctccatttaggagtagctattggtaagaacactttttatgtaactttcccatgtgagttggagttgttgatggcaaatattgacatttgtgtctaagggaaacagttgggaaactgttgtttacatacttcatgctataaatttaaagtgtttgtttaggggtggaattgctatttggcataaataggaattcctaaattatcactaaatgaagtaaccatctactaaaattacctattttatctaatgtgcattttcacttgctgttaacttggatcgtcagtacagaacataatgtaaccttagaatgcataggcgttttccccattagagcatcccgcttataaaatatttcttgttcgtattattttaagaagttctttatcaattttgtgtttcttcaggtgactcaactacagcctgcctggatatggatgatgccaataaaaaattagtattttccctttggaaaacttgtgaacatgtgaatacacatgtgaacagtcttacatttgaaaaaccaatgttctacaacttggaaagttttcattttttatattttgctgaaatatgtcacagtggcattgcagttgtctgttagctttgggttgcagtgctagatattgttttaaattattttcattttaaacaagatgccttctaagctattgagcttattaaaaataattttacatgtttacttagttggagcaaaaataagtctattttaacaaatagctttgtttttgcatgctaatgtcagaaaggcatacgatgcacattatgctctgttttaaaggttttaccacccttgtaaaaactataatcttaaatggttttatttgctgttacacaaacaacactacataaaacattttttcctaaatggtacaaatttataaactatcatttttcacttacggtatttgtaaatactacactacaaaaatcagctttctgagaaagaaataatcatttatttatgatattgaaaatttctacagtaaacactcaaaaccaagcaaaaaacatttgtaagatacacggtatctatttggagcaacggtttttgtaactaatgtgtttcattttttaaataaagacaactaaaaataaatctctttctgcaatgatttttatagcagaaattgacttatctggagtgttctagcaatttttaggtcatttagcagaacagtaagcttccagaggaaacctacacttctatcctttgggcctggcctgttctgtttctgggttctttccgcagtcaagtacaccgagtaacaggttaaagaatggcagtttcacctggcctttacagggacacttacttctttcagaagtcattaagtcggcttttattattcctaaacaaaagagctttattttctcatgagtaggttttagagttttaattgttgacaatttttcagttactaatagaaccccagtcatttcattttatttttccaaggacaagagtctattaagggaaccattaactattcagtacagtgaattactttcagattactaaggaaaaggaaagtgagcagttataagatgccaaacacctatctatctgcctgaaatatgcacctttcaggttggacctaataacattcacctccccttgctgaaaagccttccaacacccacgaggccatctcagtttccatgctaccttttctgtaactctactaataaccaaaccacatcatgtgttcaccaaactgagttatcccagtaactaccattatcatctttgtctccactggcctggcacacaaggtattcagtaaatacgttgaatgaagaatatgaagatgcgtggtttttcttttttcacttattactaacccagcttgggcctttgcatgggaagagaaaaaggcttgctgggacttcagataattttatcatacaggtaaagcagtggttctcaacatctggagacatttttggttgtcattccaagatggtgctgttgccatctagtgtgtggaggccagggatgctgctacaatcaaccctatcaacagagaatgatccagcccaaaacatcaactgaagtcgagaagctccatcattttggcaatatgaataacaatctaaatcaccaccctagttcctttaacacatcatctaccttagtctgtctccttcatactctgaagagtcagtgtttatctgtggtaaacaacagcatctgccgtgaggctcatcactgtcaggggaaagggccttatatgtaaacactttatcatttcaactacacaaaaattatttactaaagcacctactctacctgacagttcacttactcccttataactgctgcta

SEQ ID NO: 307054 - DNA, 2688 bp, Homo sapiens
aacatactgagttaacacattttcctagtagtgatagaattttcagggaagcaagaaaccaagaaaattctggctgctacctaattttaatgaagtggcgattatctgcccacaaggtatgagaagtatagatgtgcattgctctacaaatatacaacgcaataaggcccactcgaaattcatgaaaggcttgccaagccacatggcttgattggtcgtaggtagatgcatgatgtccctcttagaatgaggcccatgtttaaaatccacatttacaaaaggagtaggtacaattgtgatgttttgaggtaaccaaagtgtgtcatgaaaaagaacgtcaagaagaaaggcagaggaactcatgagtttgaatggttaaactgaaggcaagaaaaagtcctaagaataaaactgaaaaatattttaatatgcctatgtatctttcacagagtggattcaactgcacataagaagaacataatgttgaagtcatttcagagtgcaaatatcattgaattgcttcattatcaccagtgtgactctcgatcatcaacaaaagcagaaattctgaaatgtttgctaaacctgcaaattcagcatattgatgccaggtttgctgtcctcctaacagacaagcctactatccccagagaagtctttgaaaataatggaatccttgttacagatgtaaataactttatagaaaacatagaaaaaatagcagctccatttaggagtagctattggtgactcaactacagcctgcctggatatggatgatgccaataaaaaattagtattttccctttggaaaacttgtgaacatgtgaatacacatgtgaacagtcttacatttgaaaaaccaatgttctacaacttggaaagttttcattttttatattttgctgaaatatgtcacagtggcattgcagttgtctgttagctttgggttgcagtgctagatattgttttaaattattttcattttaaacaagatgccttctaagctattgagcttattaaaaataattttacatgtttacttagttggagcaaaaataagtctattttaacaaatagctttgtttttgcatgctaatgtcagaaaggcatacgatgcacattatgctctgttttaaaggttttaccacccttgtaaaaactataatcttaaatggttttatttgctgttacacaaacaacactacataaaacattttttcctaaatggtacaaatttataaactatcatttttcacttacggtatttgtaaatactacactacaaaaatcagctttctgagaaagaaataatcatttatttatgatattgaaaatttctacagtaaacactcaaaaccaagcaaaaaacatttgtaagatacacggtatctatttggagcaacggtttttgtaactaatgtgtttcattttttaaataaagacaactaaaaataaatctctttctgcaatgatttttatagcagaaattgacttatctggagtgttctagcaatttttaggtcatttagcagaacagtaagcttccagaggaaacctacacttctatcctttgggcctggcctgttctgtttctgggttctttccgcagtcaagtacaccgagtaacaggttaaagaatggcagtttcacctggcctttacagggacacttacttctttcagaagtcattaagtcggcttttattattcctaaacaaaagagctttattttctcatgagtaggttttagagttttaattgttgacaatttttcagttactaatagaaccccagtcatttcattttatttttccaaggacaagagtctattaagggaaccattaactattcagtacagtgaattactttcagattactaaggaaaaggaaagtgagcagttataagatgccaaacacctatctatctgcctgaaatatgcacctttcaggttggacctaataacattcacctccccttgctgaaaagccttccaacacccacgaggccatctcagtttccatgctaccttttctgtaactctactaataaccaaaccacatcatgtgttcaccaaactgagttatcccagtaactaccattatcatctttgtctccactggcctggcacacaaggtattcagtaaatacgttgaatgaagaatatgaagatgcgtggtttttcttttttcacttattactaacccagcttgggcctttgcatgggaagagaaaaaggcttgctgggacttcagataattttatcatacaggtaaagcagtggttctcaacatctggagacatttttggttgtcattccaagatggtgctgttgccatctagtgtgtggaggccagggatgctgctacaatcaaccctatcaacagagaatgatccagcccaaaacatcaactgaagtcgagaagctccatcattttggcaatatgaataacaatctaaatcaccaccctagttcctttaacacatcatctaccttagtctgtctccttcatactctgaagagtcagtgtttatctgtggtaaacaacagcatctgccgtgaggctcatcactgtcaggggaaagggccttatatgtaaacactttatcatttcaactacacaaaaattatttactaaagcacctactctacctgacagttcacttactcccttataactgctgcta

SEQ ID NO: 307055 - DNA, 1884 bp, Homo sapiens
caacttggaaagttttagaacattggtttttcaaatgtaagactgttcacatgtgtattcaatgttctacaacttggaaagttttcattttttatattttgctgaaatatgtcacagtggcattgcagttgtctgttagctttgggttgcagtgctagatattgttttaaattattttcattttaaacaagatgccttctaagctattgagcttattaaaaataattttacatgtttacttagttggagcaaaaataagtctattttaacaaatagctttgtttttgcatgctaatgtcagaaaggcatacgatgcacattatgctctgttttaaaggttttaccacccttgtaaaaactataatcttaaatggttttatttgctgttacacaaacaacactacataaaacattttttcctaaatggtacaaatttataaactatcatttttcacttacggtatttgtaaatactacactacaaaaatcagctttctgagaaagaaataatcatttatttatgatattgaaaatttctacagtaaacactcaaaaccaagcaaaaaacatttgtaagatacacggtatctatttggagcaacggtttttgtaactaatgtgtttcattttttaaataaagacaactaaaaataaatctctttctgcaatgatttttatagcagaaattgacttatctggagtgttctagcaatttttaggtcatttagcagaacagtaagcttccagaggaaacctacacttctatcctttgggcctggcctgttctgtttctgggttctttccgcagtcaagtacaccgagtaacaggttaaagaatggcagtttcacctggcctttacagggacacttacttctttcagaagtcattaagtcggcttttattattcctaaacaaaagagctttattttctcatgagtaggttttagagttttaattgttgacaatttttcagttactaatagaaccccagtcatttcattttatttttccaaggacaagagtctattaagggaaccattaactattcagtacagtgaattactttcagattactaaggaaaaggaaagtgagcagttataagatgccaaacacctatctatctgcctgaaatatgcacctttcaggttggacctaataacattcacctccccttgctgaaaagccttccaacacccacgaggccatctcagtttccatgctaccttttctgtaactctactaataaccaaaccacatcatgtgttcaccaaactgagttatcccagtaactaccattatcatctttgtctccactggcctggcacacaaggtattcagtaaatacgttgaatgaagaatatgaagatgcgtggtttttcttttttcacttattactaacccagcttgggcctttgcatgggaagagaaaaaggcttgctgggacttcagataattttatcatacaggtaaagcagtggttctcaacatctggagacatttttggttgtcattccaagatggtgctgttgccatctagtgtgtggaggccagggatgctgctacaatcaaccctatcaacagagaatgatccagcccaaaacatcaactgaagtcgagaagctccatcattttggcaatatgaataacaatctaaatcaccaccctagttcctttaacacatcatctaccttagtctgtctccttcatactctgaagagtcagtgtttatctgtggtaaacaacagcatctgccgtgaggctcatcactgtcaggggaaagggccttatatgtaaacactttatcatttcaactacacaaaaattatttactaaagcacctactctacctgacagttcacttactcccttataactgctgcta

SEQ ID NO: 307056 - DNA, 1632 bp, Homo sapiens
cacacgcagcgttttgataaattattggttttcaaaaaaaaaaaaaaaaaaaaaaactcgatgcacattatgctctgttttaaaggttttaccacccttgtaaaaactataatcttaaatggttttatttgctgttacacaaacaacactacataaaacattttttcctaaatggtacaaatttataaactatcatttttcacttacggtatttgtaaatactacactacaaaaatcagctttctgagaaagaaataatcatttatttatgatattgaaaatttctacagtaaacactcaaaaccaagcaaaaaacatttgtaagatacacggtatctatttggagcaacggtttttgtaactaatgtgtttcattttttaaataaagacaactaaaaataaatctctttctgcaatgatttttatagcagaaattgacttatctggagtgttctagcaatttttaggtcatttagcagaacagtaagcttccagaggaaacctacacttctatcctttgggcctggcctgttctgtttctgggttctttccgcagtcaagtacaccgagtaacaggttaaagaatggcagtttcacctggcctttacagggacacttacttctttcagaagtcattaagtcggcttttattattcctaaacaaaagagctttattttctcatgagtaggttttagagttttaattgttgacaatttttcagttactaatagaaccccagtcatttcattttatttttccaaggacaagagtctattaagggaaccattaactattcagtacagtgaattactttcagattactaaggaaaaggaaagtgagcagttataagatgccaaacacctatctatctgcctgaaatatgcacctttcaggttggacctaataacattcacctccccttgctgaaaagccttccaacacccacgaggccatctcagtttccatgctaccttttctgtaactctactaataaccaaaccacatcatgtgttcaccaaactgagttatcccagtaactaccattatcatctttgtctccactggcctggcacacaaggtattcagtaaatacgttgaatgaagaatatgaagatgcgtggtttttcttttttcacttattactaacccagcttgggcctttgcatgggaagagaaaaaggcttgctgggacttcagataattttatcatacaggtaaagcagtggttctcaacatctggagacatttttggttgtcattccaagatggtgctgttgccatctagtgtgtggaggccagggatgctgctacaatcaaccctatcaacagagaatgatccagcccaaaacatcaactgaagtcgagaagctccatcattttggcaatatgaataacaatctaaatcaccaccctagttcctttaacacatcatctaccttagtctgtctccttcatactctgaagagtcagtgtttatctgtggtaaacaacagcatctgccgtgaggctcatcactgtcaggggaaagggccttatatgtaaacactttatcatttcaactacacaaaaattatttactaaagcacctactctacctgacagttcacttactcccttataactgctgcta

SEQ ID NO: 307057 - DNA, 2453 bp, Homo sapiens
gtatatccctcagtgtcagaagaaccagtagaaaataaggagagaaagggggataatttacaaccagttactttaatactttctaaagaaaattgcacccttgagattgcagaggaaattaatgtgacctctgattttccctttgattctgtaattgaagaagtatcaccagcgtctagtcctgaacctccagtaccagttaaagagacacgaccatatcaggctgtgactccatgcattttaaaacttcatggtacacagtgtgagaagagcaaccaaatctcccaatgtgagtcagaagacttaggcataacagaaaaagaaaatgtttttgttggtcctacccatccagtggggcaagataactttacccaggtacaacaaatgcaggtctctgccgaaatgcctctaatattaactgatcatccaggaagaacaggtagaccaacccttcctggtaaagtaactgaggaaattgtctcaagtgagcatgatgagggtttatctttctcaggaaaggtgcagtgctatggtagggagttaaaccagcctgcctcagctgccaaatgcacaggtgacttcagtccttctcctgaaaaactggtaaaatcaggaaatccattgcagccagttagtatagagaatagaaatttggacttaaaacatcttgtcttggagtccagtgaacctccatttggtcctagaaatgttattgaaaataagtctttgtctgacacattggtttccacaactgcaccaagtggtatagtgaatgtgtcagtaaaacagcagactagccctaaaagcagtcagaaccatctctttcccggtgatttgaaaacagatgaaggcatttatctgcaggtgaagtccttgacagctgcctcggttgatggagcttattctacacagggatgcatgtgctcagtggtccccacgctttgttcttcctcagacaatgctacattaacccattatgtaagaccaataaatgcagagccagcgtttcaagcacaggaaataccagcaggcagaatggccagtttgcttaagaatggtgagcctgaagctgagttacataaagaaaccacaggtccaggcactgctggccctcagtccaacaccacatcttctctaaaaggtgaacgcaaagccatccacacgctgcaagatgtgtcaacatgtgaaacaaaggagctattgaatgtcggggtttcctccctttgtgctggtccctaccaaaatacagcagacaccaaggaaaacctcagtaaagagcctttggcctcctttgtttcagaatcctttgatacttctgtttgtggaatagccacagagcacgtagaaattgagaacagtggggaggggctcagggctgaggctggttctgaaaccctaggcagagatggagaggtcggtgtgaattccgacatgcactatgaactctctggagattctgatctagacctgcttggtgattgtagaaatcccagactggatttggaggattcttatactttaagaggtagttacaccaggaaaaaagatgttcccacagatggctatgagtcgtcgttgaacttccacaacaacaaccaagaggactggggctgctctagctgggttccaggcatggagacgagcctccctcccgggcactggactgctgcggtaaagaaagaagagaagtgtgtgccgccttacgtccaaatccgagatctccacgggatcctcaggacttacgccaacttctctataacaaaagaactcaaagataccatgagaacttcacacggcctgaggaggcacccgagtttcagtgcaaactgtggcctgcccagctcctggacaagcacttggcaggtggcagacgacctcacccagaacactttagacctggagtatctgcgttttgcacataaactaaaacagaccataaagaatggggattctcagcattctgcctcctctgccaatgtctttccaaaggagtcaccaacccagatctccattggtgctttcccttcgacaaaaatctctgaggccccatttctgcatcctgcacctaggagcagaagcccccttctggtaacagttgtggagtcagatcccagaccacaggggcagcccaggagaggctacacagccagcagtctggacagctcttcctcttggagagagagatgtagtcataatagagatcttagaaattctcaaagaaatcacactgtttcattccacctcaacaaactgaaatacaacagtaacctctgcagacttaaatgtccctgtgtgacagctttgaagagagcagtggttctcccagcacgcagcttgagatctgagaacgggcagactgcctcctcaagtgagtccctgacacctgacccccaagcagcctaactaactgggaggcaccccccagtaggggcagactgacacatcacatgccg

SEQ ID NO: 307058 - DNA, 746 bp, Homo sapiens
ctggcattatgtaacaggcgttatgtattattgagaactcattagaaaactcttcatatcctttgaccttttgtggaatttacccaaaattctaggtggttatcagtcattgcaaaaccaacctcagttccatctctaggagggagatatgcagactacagttaaatattttaaagtttatacaaaataatgcccacccaaaacttacacaatagaagcatgtaaaaagtttctattcatagaaagagggatggcataaaagttggtatcatgtaactatgttcagtatgatgtcataaaaaatttatacaggaaaaagtgaaaggaaattaattcatgatgttaagagtgattatcactagggttatgggaatgggtgtgatttgggttttctccaacaagcatgagaatgtaagtgatgaaaactagagagacgggagtcgagcagagacagaaatgctaaaaatttaaacatactgagttaacacattttcctagtagtgatagaattttcagggaagcaagaaaccaagaaaattctggctgctacctaattttaatgaagtggcgattatctgcccacaaggtatgagaagtatagatgtgcattgctctacaaatatacaacgcaataaggcccactcgaaattcatgaaaggcttgccaagccacatggcttgattggtcgtaggtagatgcatgatgtccctcttagaatgaggcccatgtttaaaatccacatttac

SEQ ID NO: 307059 - DNA, 412 bp, Homo sapiens
taagaagtgttgtgaaagaggcttgtaaaagtaccttcctgttctaccttgtcgaaacagaagacaaatcattctttgtaagaacaaaggtaaagtgccagccacgtcttacgtattattttaattgctgattttagttttagaaataataaatttagcatattagccatcaaaaagaaatcatggtatgacatagtatttaaatttcacagcttagtctttatctgcatactaaatgttttcctgcaggatctgccatttgtactatatttgaaaattagtattatgttccagaattagggcaatgactaattttttttcacaaaaagttaccagtgtagacatgcccatacttcaagtgtaaatacaaacacattccgatgttaaaatacagattttttgaaaagtggtt

SEQ ID NO: 307060 - DNA, 3711 bp, Homo sapiens
gcgtgtgtgtaagtgcatgtgtgtggagtgtgtgtgtggggtatgtgtgcatatgtgtattggtgtgtgagaccgtatgagtgcatgtgtgtggagtgtgtgtgcagtatgtgtgtgtgtgtgtgtgtgtgtctccctctctcacacacacaagagcagtttgctgttgctgtttcctaccttctgaggcttcaaagtattttttaaaatctatgctttgtggcagctctacggtgcttatctctgtctttgtgtcaatccttaagtacccatgtctttttcatgtctaaccattgggaaggtagaggctggcagggaagacaaatctgctacaagtccatgggaagaccctacaatgaaatgttcattggttggtatactgttttagtcttgaattgccaactttccaactgatctatccatattccttaagtactaaagacaaaatagagggcttctttttctctcttaatgtcttgccttctggttttcctggtttgcaagactaagtgtacctaatctcaccatctcttcacttctagctctctgaaacaagggtcacactactcagagggataaccccttacagtggtctgaggagtaactatttcctaaagtattctaaaagagtaggaagagagaaatggtagcctgctgcttctcacagacacctcacatcctcacttgggatggcatccacatagaaaccctgcatttaggtaaaatttgcctgactgaaggggactcagtcctccaaatcaaggtcaagaagatatctgcatgagaccttaagaactctttattgccattatttggagagggcgggggaattgtcctaatcacacatttaacacagggaataagtgctgaagtgacccagatcaccaagcgcagttcctcatcatactttatttttgctttccttattccttggcactgactaagctaaagttaagaagccgacttcataagccaacccctgtgatgggatggaaaaatgggcttttgcagagggtttattaatagagatggatatactactcacaagttctggctcatggctccactgagaaggccatagtaataaaatgatcttatgaacactgttccccaaaggccaaagcctgaagatattgccccttataatccaatcagccttatattttaataagtcctgaatcaacctgactacggatatatggggccaccagggtgcatgggtgcatgtctgctcagcctagccctggaagtgagcactgccggccacagatcctgggaaaggtggtagtaacccagaagatgtagccttgaagggaggatacctatcaaaatgccaaagctgcagggacacgaagacggttgaaaattcaacctatgtatactagatccttccagtttgatggtttggtcattcttcttcatgattataccatggagaattttctgtgacaagggtggtcatggaagtaagtgagtgatcccctggtttctcattccttaaagcagtggttcgcaaagtatggcacaagaccagcagcatcagcagcctttgggaacttgttagaaacgaaaattctcaatcccatcccagatctgctgaatcagaaactctaatgagaggacccggcaatccacgttttaataagccctcctggtgattctgatgcacactaaattcaactgttttaaagggaaagccctttatagtattggagttcccacactgagaggctttggggcccaaaataagaaggttctaggttgtcattcagactttaacattaatttcaaagtcacctttctcatgcttccttgtgtttctgtttttccatttatgattttaacaaagaaaggtatgtgtgcttttgggtggaagttaggagaatgtttgtgtctttcctagttgaatacaaccttcagagaaaaaccttatgccttggaaattactacctggcacacaaaggggcttcaacaaggaaaagcagttggaggtctcttccagattgctcttctgccgaattatttgtatctattccgagctgattatgtaataggatggaaaaagtaaaaaaaaaaaaaaaaaatctaatttgtatttccatgacaacgtgttctcccagcaacatccctctcctttatttgagttataaagggcactgctgggcctgagaaccaggccagaacctccttctgtatggcagctaacagtgtagggctccagtatcccaggaaggccccttatccacactccactcagctcataggagagtcttgcataatgaagacacagacctgggcacttcagtccttgtgctcctcctctcttttccccacagcaggacctggatacagaagtactcagccaaggtgacagaataaaatcctttttttgttgttttctgtttgtttgtttgttttggagaaggagtctcgctttgtcacccaggctggtgtgcagtggcacgatctcggctcactgcaacctccgcctcccaggttcaagcgattctcctgtctcagcctcctgagtagctgggattacagacgtgcgccatcacgcccagctaatttttgtatttttagtagatacggagttttgccttgttggccaggctgtgctggagctcctgacctcaggtgattcacctgccacagcctcccaaagtgctgggattacaggcgtgagccacagcaccctgccaaataagatcctttttaaaaaatatctgaaaaaagcttcatatctttacaaactcataaaatagctgattgggccatggaggagatgaggctgtttagaactggttttgtttcaagtttgtcaattttccctgtatgagaacttgggtaaagcacaaagaaacatacagtgctagtaacaggtctcctgcgccctggaactaagtgtttggaggaaggactaaaccccgggggaggtgagtataaaataattccactaagatcacctcctcagtccccagaaggctgatggtggatcctctggccatctcctgtggggtcttactgctcctctgccatttctctatgcctgaagacacgaagatgatatcaaggcagagctaccatatcgcagccagtctctaggctactgctgtgcagtggctcccactttctaatgcttttttgtttttgctttttctaacaaaacaatcttttttcaaaatgaattccaacccctgctagcttccttccccgcctccatactgttttaggcagcaccgtttatgtgacagagtccgtgtttctcaaatgcatggtgttcctcaggtggagagtgggcagaagtttttgcaacactttttttttaagttattgggtgcaaaatcccaaaccaggatatgtgtatgtctgtgtgtttatgttttttatttgaccctcccctctttcaacctacccccttttatatctaatgtagaaaaagcgaaattgaatctggaaagcaaactgttgtatatagttgcggtaacaatcatgaagagagagccgggctgtcccctcagtaattcattttaaataacaaattatttaaaaataaaattcatgccagagccagctgaagaggccttccttcatcaccactgaggccacccccaatctgggccctctgtccatctggcatgtctcctcccagcaagattcatctgttcaatgccatttgcgtttcaataaagttatctcctgtactgtcca

SEQ ID NO: 307061 - DNA, 3882 bp, Homo sapiens
gcgtgtgtgtaagtgcatgtgtgtggagtgtgtgtgtggggtatgtgtgcatatgtgtattggtgtgtgagaccgtatgagtgcatgtgtgtggagtgtgtgtgcagtatgtgtgtgtgtgtgtgtgtgtgtctccctctctcacacacacaagagcagtttgctgttgctgtttcctaccttctgaggcttcaaagtattttttaaaatctatgctttgtggcagctctacggtgcttatctctgtctttgtgtcaatccttaagtacccatgtctttttcatgtctaaccattgggaaggtagaggctggcagggaagacaaatctgctacaagtccatgggaagaccctacaatgaaatgttcattggttggtatactgttttagtcttgaattgccaactttccaactgatctatccatattccttaagtactaaagacaaaatagagggcttctttttctctcttaatgtcttgccttctggttttcctggtttgcaagactaagtgtacctaatctcaccatctcttcacttctagctctctgaaacaagggtcacactactcagagggataaccccttacagtggtctgaggagtaactatttcctaaagtattctaaaagagtaggaagagagaaatggtagcctgctgcttctcacagacacctcacatcctcacttgggatggcatccacatagaaaccctgcatttaggtaaaatttgcctgactgaaggggactcagtcctccaaatcaaggtcaagaagatatctgcatgagaccttaagaactctttattgccattatttggagagggcgggggaattgtcctaatcacacatttaacacagggaataagtgctgaagtgacccagatcaccaagcgcagttcctcatcatactttatttttgctttccttattccttggcactgactaagctaaagttaagaagccgacttcataagccaacccctgtgatgggatggaaaaatgggcttttgcagagggtttattaatagagatggatatactactcacaagttctggctcatggctccactgagaaggccatagtaataaaatgatcttatgaacactgttccccaaaggccaaagcctgaagatattgccccttataatccaatcagccttatattttaataagtcctgaatcaacctgactacggatatatggggccaccagggtgcatgggtgcatgtctgctcagcctagccctggaagtgagcactgccggccacagatcctgggaaaggtggtagtaacccagaagatgtagccttgaagggaggatacctatcaaaatgccaaagctgcagggacacgaagacggttgaaaattcaacctatgtatactagatccttccagtttgatggtttggtcattcttcttcatgattataccatggagaattttctgtgacaagggtggtcatggaagtaagtgagtgatcccctggtttctcattccttaaagcagtggttcgcaaagtatggcacaagaccagcagcatcagcagcctttgggaacttgttagaaacgaaaattctcaatcccatcccagatctgctgaatcagaaactctaatgagaggacccggcaatccacgttttaataagccctcctggtgattctgatgcacactaaattcaactgttttaaagggaaagccctttatagtattggagttcccacactgagaggctttggggcccaaaataagaaggttctaggttgtcattcagactttaacattaatttcaaagtcacctttctcatgcttccttgtgtttctgtttttccatttatgattttaacaaagaaaggtatgtgtgcttttgggtggaagttaggagaatgtttgtgtctttcctagttgaatacaaccttcagagaaaaaccttatgccttggaaattactacctggcacacaaaggggcttcaacaaggaaaagcagttggaggtctcttccagattgctcttctgccgaattatttgtatctattccgagctgattatgtaataggatggaaaaagtaaaaaaaaaaaaaaaaaatctaatttgtatttccatgacaacgtgttctcccagcaacatccctctcctttatttgagttataaagggcactgctgggcctgagaaccaggccagaacctccttctgtatggcagctaacagtgtagggctccagtatcccaggaaggccccttatccacactccactcagctcataggagagtcttgcataatgaagacacagacctgggcacttcagtccttgtgctcctcctctcttttccccacagcaggacctggatacagaagtactcagccaaggtgacagaataaaatcctttttttgttgttttctgtttgtttgtttgttttggagaaggagtctcgctttgtcacccaggctggtgtgcagtggcacgatctcggctcactgcaacctccgcctcccaggttcaagcgattctcctgtctcagcctcctgagtagctgggattacagacgtgcgccatcacgcccagctaatttttgtatttttagtagatacggagttttgccttgttggccaggctgtgctggagctcctgacctcaggtgattcacctgccacagcctcccaaagtgctgggattacaggcgtgagccacagcaccctgccaaataagatcctttttaaaaaatatctgaaaaaagcttcatatctttacaaactcataaaatagctgattgggccatggaggagatgaggctgtttagaactggttttgtttcaagtttgtcaattttccctgtatgagaacttgggtaaagcacaaagaaacatacagtgctagtaacaggtctcctgcgccctggaactaagtgtttggaggaaggactaaaccccgggggaggtgagtataaaataattccactaagatcacctcctcagtccccagaaggctgatggtggatcctctggccatctcctgtggggtcttactgctcctctgccatttctctatgcctgaagacacgaagatgatatcaaggcagagctaccatatcgcagccagtctctaggctactgctgtgcagtggctcccactttctaatgcttttttgtttttgctttttctaacaaaacaatcttttttcaaaatgaattccaacccctgctagcttccttccccgcctccatactgttttaggcagcaccgtttatgtgacagagtccgtgtttctcaaatgcatggtgttcctcaggtggagagtgggcagaagtttttgcaacactttttttttaagttattgggtgcaaaatcccaaaccaggatatgtgtatgtctgtgtgtttatgttttttatttgaccctcccctctttcaacctacccccttttatatctaatgtagaaaaagcgaaattgaatctggaaagcaaactgttgtatatagttgcggtaacaatcatgaagagagagccgggctgtcccctcagtaattcattttaaataacaaattatttaaaaataaaattcatgccagagccagctgaagaggccttccttcatcaccactgaggccacccccaatctgggccctctgtccatctggcatgtctcctcccagcaagattcatctgttcaatgccatttgcgtttcaataaagttatctcctgtactgtccaaaaaaaaaaaaaaaaaaaaaaggggggcggaaaaatcccgaggggccagtaagcgaccccgttttggcaaggccccaaggggggaaaaaagagacggggcgtcaaaggcgggggaacggctgggcttggagagacctccgggggcaggggacccacagaaccggaaaaaag

SEQ ID NO: 307062 - DNA, 3673 bp, Homo sapiens
gcgtgtgtgtaagtgcatgtgtgtggagtgtgtgtgtggggtatgtgtgcatatgtgtattggtgtgtgagaccgtatgagtgcatgtgtgtggagtgtgtgtgcagtatgtgtgtgtgtgtgtgtgtgtgtctccctctctcacacacacaagagcagtttgctgttgctgtttcctaccttctgaggcttcaaagtattttttaaaatctatgctttgtggcagctctacggtgcttatctctgtctttgtgtcaatccttaagtacccatgtctttttcatgtctaaccattgggaaggtagaggctggcagggaagacaaatctgctacaagtccatgggaagaccctacaatgaaatgttcattggttggtatactgttttagtcttgaattgccaactttccaactgatctatccatattccttaagtactaaagacaaaatagagggcttctttttctctcttaatgtcttgccttctggttttcctggtttgcaagactaagtgtacctaatctcaccatctcttcacttctagctctctgaaacaagggtcacactactcagagggataaccccttacagtggtctgaggagtaactatttcctaaagtattctaaaagagtaggaagagagaaatggtagcctgctgcttctcacagacacctcacatcctcacttgggatggcatccacatagaaaccctgcatttaggtaaaatttgcctgactgaaggggactcagtcctccaaatcaaggtcaagaagatatctgcatgagaccttaagaactctttattgccattatttggagagggcgggggaattgtcctaatcacacatttaacacagggaataagtgctgaagtgacccagatcaccaagcgcagttcctcatcatactttatttttgctttccttattccttggcactgactaagctaaagttaagaagccgacttcataagccaacccctgtgatgggatggaaaaatgggcttttgcagagggtttattaatagagatggatatactactcacaagttctggctcatggctccactgagaaggccatagtaataaaatgatcttatgaacactgttccccaaaggccaaagcctgaagatattgccccttataatccaatcagccttatattttaataagtcctgaatcaacctgactacggatatatggggccaccagggtgcatgggtgcatgtctgctcagcctagccctggaagtgagcactgccggccacagatcctgggaaaggtggtagtaacccagaagatgtagccttgaagggaggatacctatcaaaatgccaaagctgcagggacacgaagacggttgaaaattcaacctatgtatactagatccttccagtttgatggtttggtcattcttcttcatgattataccatggagaattttctgtgacaagggtggtcatggaagtaagtgagtgatcccctggtttctcattccttaaagcagtggttcgcaaagtatggcacaagaccagcagcatcagcagcctttgggaacttgttagaaacgaaaattctcaatcccatcccagatctgctgaatcagaaactctaatgagaggacccggcaatccacgttttaataagccctcctggtgattctgatgcacactaaattcaactgttttaaagggaaagccctttatagtattggagttcccacactgagaggctttggggcccaaaataagaaggttctaggttgtcattcagactttaacattaatttcaaagtcacctttctcatgcttccttgtgtttctgtttttccatttatgattttaacaaagaaaggtatgtgtgcttttgggtggaagttaggagaatgtttgtgtctttcctagttgaatacaaccttcagagaaaaaccttatgccttggaaattactacctggcacacaaaggggcttcaacaaggaaaagcagttggaggtctcttccagattgctcttctgccgaattatttgtatctattccgagctgattatgtaataggatggaaaaagtaaaaaaaaaaaaaaaaaatctaatttgtatttccatgacaacgtgttctcccagcaacatccctctcctttatttgagttataaagggcactgctgggcctgagaaccaggccagaacctccttctgtatggcagctaacagtgtagggctccagtatcccaggaaggccccttatccacactccactcagctcataggagagtcttgcataatgaagacacagacctgggcacttcagtccttgtgctcctcctctcttttccccacagcaggacctggatacagaagtactcagccaaggtgacagaataaaatcctttttttgttgttttctgtttgtttgtttgttttggagaaggagtctcgctttgtcacccaggctggtgtgcagtggcacgatctcggctcactgcaacctccgcctcccaggttcaagcgattctcctgtctcagcctcctgagtagctgggattacagacgtgcgccatcacgcccagctaatttttgtatttttagtagatacggagttttgccttgttggccaggctgtgctggagctcctgacctcaggtgattcacctgccacagcctcccaaagtgctgggattacaggcgtgagccacagcaccctgccaaataagatcctttttaaaaaatatctgaaaaaagcttcatatctttacaaactcataaaatagctgattgggccatggaggagatgaggctgtttagaactggttttgtttcaagtttgtcaattttccctgtatgagaacttgggtaaagcacaaagaaacatacagtgctagtaacaggtctcctgcgccctggaactaagtgtttggaggaaggactaaaccccgggggaggtgagtataaaataattccactaagatcacctcctcagtccccagaaggctgatggtggatcctctggccatctcctgtggggtcttactgctcctctgccatttctctatgcctgaagacacgaagatgatatcaaggcagagctaccatatcgcagccagtctctaggctactgctgtgcagtggctcccactttctaatgcttttttgtttttgctttttctaacaaaacaatcttttttcaaaatgaattccaacccctgctagcttccttccccgcctccatactgttttaggcagcaccgtttatgtgacagagtccgtgtttctcaaatgcatggtgttcctcaggtggagagtgggcagaagtttttgcaacactttttttttaagttattgggtgcaaaatcccaaaccaggatatgtgtatgtctgtgtgtttatgttttttatttgaccctcccctctttcaacctacccccttttatatctaatgtagaaaaagcgaaattgaatctggaaagcaaactgttgtatatagttgcggtaacaatcatgaagagagagccgggctgtcccgttgttttgagacagagtctcagtctgtcgcccaggctggagtgcagtggtgcgatctcggctcactgcaacctccgcctcctgggttcaagcaattctcctgcctcagcctcccgagtagctgggattacaggcacctgccaccatgcctggctaa

SEQ ID NO: 307063 - DNA, 3443 bp, Homo sapiens
gcgtgtgtgtaagtgcatgtgtgtggagtgtgtgtgtggggtatgtgtgcatatgtgtattggtgtgtgagaccgtatgagtgcatgtgtgtggagtgtgtgtgcagtatgtgtgtgtgtgtgtgtgtgtgtctccctctctcacacacacaagagcagtttgctgttgctgtttcctaccttctgaggcttcaaagtattttttaaaatctatgctttgtggcagctctacggtgcttatctctgtctttgtgtcaatccttaagtacccatgtctttttcatgtctaaccattgggaaggtagaggctggcagggaagacaaatctgctacaagtccatgggaagaccctacaatgaaatgttcattggttggtatactgttttagtcttgaattgccaactttccaactgatctatccatattccttaagtactaaagacaaaatagagggcttctttttctctcttaatgtcttgccttctggttttcctggtttgcaagactaagtgtacctaatctcaccatctcttcacttctagctctctgaaacaagggtcacactactcagagggataaccccttacagtggtctgaggagtaactatttcctaaagtattctaaaagagtaggaagagagaaatggtagcctgctgcttctcacagacacctcacatcctcacttgggatggcatccacatagaaaccctgcatttaggtaaaatttgcctgactgaaggggactcagtcctccaaatcaaggtcaagaagatatctgcatgagaccttaagaactctttattgccattatttggagagggcgggggaattgtcctaatcacacatttaacacagggaataagtgctgaagtgacccagatcaccaagcgcagttcctcatcatactttatttttgctttccttattccttggcactgactaagctaaagttaagaagccgacttcataagccaacccctgtgatgggatggaaaaatgggcttttgcagagggtttattaatagagatggatatactactcacaagttctggctcatggctccactgagaaggccatagtaataaaatgatcttatgaacactgttccccaaaggccaaagcctgaagatattgccccttataatccaatcagccttatattttaataagtcctgaatcaacctgactacggatatatggggccaccagggtgcatgggtgcatgtctgctcagcctagccctggaagtgagcactgccggccacagatcctgggaaaggtggtagtaacccagaagatgtagccttgaagggaggatacctatcaaaatgccaaagctgcagggacacgaagacggttgaaaattcaacctatgtatactagatccttccagtttgatggtttggtcattcttcttcatgattataccatggagaattttctgtgacaagggtggtcatggaagtaagtgagtgatcccctggtttctcattccttaaagcagtggttcgcaaagtatggcacaagaccagcagcatcagcagcctttgggaacttgttagaaacgaaaattctcaatcccatcccagatctgctgaatcagaaactctaatgagaggacccggcaatccacgttttaataagccctcctggtgattctgatgcacactaaattcaactgttttaaagggaaagccctttatagtattggagttcccacagtctcttccagattgctcttctgccgaattatttgtatctattccgagctgattatgtaataggatggaaaaagtaaaaaaaaaaaaaaaaaatctaatttgtatttccatgacaacgtgttctcccagcaacatccctctcctttatttgagttataaagggcactgctgggcctgagaaccaggccagaacctccttctgtatggcagctaacagtgtagggctccagtatcccaggaaggccccttatccacactccactcagctcataggagagtcttgcataatgaagacacagacctgggcacttcagtccttgtgctcctcctctcttttccccacagcaggacctggatacagaagtactcagccaaggtgacagaataaaatcctttttttgttgttttctgtttgtttgtttgttttggagaaggagtctcgctttgtcacccaggctggtgtgcagtggcacgatctcggctcactgcaacctccgcctcccaggttcaagcgattctcctgtctcagcctcctgagtagctgggattacagacgtgcgccatcacgcccagctaatttttgtatttttagtagatacggagttttgccttgttggccaggctgtgctggagctcctgacctcaggtgattcacctgccacagcctcccaaagtgctgggattacaggcgtgagccacagcaccctgccaaataagatcctttttaaaaaatatctgaaaaaagcttcatatctttacaaactcataaaatagctgattgggccatggaggagatgaggctgtttagaactggttttgtttcaagtttgtcaattttccctgtatgagaacttgggtaaagcacaaagaaacatacagtgctagtaacaggtctcctgcgccctggaactaagtgtttggaggaaggactaaaccccgggggaggtgagtataaaataattccactaagatcacctcctcagtccccagaaggctgatggtggatcctctggccatctcctgtggggtcttactgctcctctgccatttctctatgcctgaagacacgaagatgatatcaaggcagagctaccatatcgcagccagtctctaggctactgctgtgcagtggctcccactttctaatgcttttttgtttttgctttttctaacaaaacaatcttttttcaaaatgaattccaacccctgctagcttccttccccgcctccatactgttttaggcagcaccgtttatgtgacagagtccgtgtttctcaaatgcatggtgttcctcaggtggagagtgggcagaagtttttgcaacactttttttttaagttattgggtgcaaaatcccaaaccaggatatgtgtatgtctgtgtgtttatgttttttatttgaccctcccctctttcaacctacccccttttatatctaatgtagaaaaagcgaaattgaatctggaaagcaaactgttgtatatagttgcggtaacaatcatgaagagagagccgggctgtcccctcagtaattcattttaaataacaaattatttaaaaataaaattcatgccagagccagctgaagaggccttccttcatcaccactgaggccacccccaatctgggccctctgtccatctggcatgtctcctcccagcaagattcatctgttcaatgccatttgcgtttcaataaagttatctcctgtactgtcca

SEQ ID NO: 307064 - DNA, 1778 bp, Homo sapiens
gcgtgtgtgtaagtgcatgtgtgtggagtgtgtgtgtggggtatgtgtgcatatgtgtattggtgtgtgagaccgtatgagtgcatgtgtgtggagtgtgtgtgcagtatgtgtgtgtgtgtgtgtgtgtgtctccctctctcacacacacaagagcagtttgctgttgctgtttcctaccttctgaggcttcaaagtattttttaaaatctatgctttgtggcagctctacggtgcttatctctgtctttgtgtcaatccttaagtacccatgtctttttcatgtctaaccattgggaaggtagaggctggcagggaagacaaatctgctacaagtccatgggaagaccctacaatgaaatgttcattggttggtatactgttttagtcttgaattgccaactttccaactgatctatccatattccttaagtactaaagacaaaatagagggcttctttttctctcttaatgtcttgccttctggttttcctggtttgcaagactaagtgtacctaatctcaccatctcttcacttctagctctctgaaacaagggtcacactactcagagggataaccccttacagtggtctgaggagtaactatttcctaaagtattctaaaagagtaggaagagagaaatggtagcctgctgcttctcacagacacctcacatcctcacttgggatggcatccacatagaaaccctgcatttaggtaaaatttgcctgactgaaggggactcagtcctccaaatcaaggtcaagaagatatctgcatgagaccttaagaactctttattgccattatttggagagggcgggggaattgtcctaatcacacatttaacacagggaataagtgctgaagtgacccagatcaccaagcgcagttcctcatcatactttatttttgctttccttattccttggcactgactaagctaaagttaagaagccgacttcataagccaacccctgtgatgggatggaaaaatgggcttttgcagagggtttattaatagagatggatatactactcacaagttctggctcatggctccactgagaaggccatagtaataaaatgatcttatgaacactgttccccaaaggccaaagcctgaagatattgccccttataatccaatcagccttatattttaataagtcctgaatcaacctgactacggatatatggggccaccagggtgcatgggtgcatgtctgctcagcctagccctggaagtgagcactgccggccacagatcctgggaaaggtggtagtaacccagaagatgtagccttgaagggaggatacctatcaaaatgccaaagctgcagggacacgaagacggttgaaaattcaacctatgtatactagatccttccagtttgatggtttggtcattcttcttcatgattataccatggagaattttctgtgacaagggtggtcatggaagtaagtgagtgatcccctggtttctcattccttaaagcagtggttcgcaaagtatggcacaagaccagcagcatcagcagcctttgggaacttgttagaaacgaaaattctcaatcccatcccagatctgctgaatcagaaactctaatgagaggacccggcaatccacgtttttactacctggcacacaaaggggcttcaacaaggaaaagcagttggaggtctcttccagattgctcttctgccgaattatttgtatctattccgagctgattatgtaataggatgaccattctgatgttggagcggccc

SEQ ID NO: 307065 - DNA, 5367 bp, Homo sapiens
tcttctttccaaacagtttgccgccctaaatccttccagtatattacttggggaggtgtcactagatctgtgtacctctgtttctcattatgtgactccattctggtttcttgcaggtttttgtttaaaggaatggtggcgttatttatttaaaacaggctttaaaagatacggttaaaacagggtagaaaaccctcacgtggcccacctgcaattcctactaacttaacataggtcccgcgtctgaggaatccccctaggtcctaaatctttggcagccaagtcaaaagtgactacgactccgggactataattcccaagagacactgcgtccgcaccctctgcgcatgttcaaccttggtgactgcataaggcagcgacgccaaggggctgggcttgggcctgagcggtgaatcggggcggggctaggggcagggccaggaggtggggtgctgccgcaccgcccggaacacgctagtggagcggaagatggcggcgcggcggcggccgctgcagccgggacttcagttgggctgaggcggaggagccgccgcttctgacctcgctctggctccggtgcgcgcggctgagcgcgtgcgaggccccgcgcgtcgggcaggggcggcggcggccactgcgcgccgccctgaggagcgccccagcggcggcgcgactgcggctgaggagagagccggctccgggcctccgcgtcctcctgctcccccggccccccgcctcctcgggggggcggcgggcgactacggactggtgacggccggctgcggcttcgggaaggacttccgtaagggcctcctcaagaagggcgcgtgctacggggacgacgcgtgcttcgtggcccggcaccgttccgcggacgtgctcggggttgcagatggtgtaggaggctggagagactatggagttgatccatctcaattctcagggactttaatgcggacgtgtgaacgtttagtaaaagaaggacggttcgtacctagtaatcccattggaattctcaccacaagctactgtgagttgctgcaaaataaagtccctttgctcggtagcagcaccgcctgcattgtggtgctggacagaaccagccaccgcttacacacagcaaacctgggcgattcaggcttcctggttgtcaggggtggtgaagtcgtgcaccgatcagatgagcagcagcattacttcaacactccattccagctctcaatcgctccccctgaagccgagggagtcgtcttgagcgacagtccggatgctgctgatagcacgtctttcgatgtccagctaggagacattatcctgacggcaacagatggactctttgacaacatgcctgattatatgattcttcaggagctaaaaaagttaaagaattcaaattatgagagtatacaacagactgccagaagcattgctgagcaagctcatgagctggcctatgacccaaattatatgtcaccttttgcacagtttgcatgtgacaatggattgaatgtgagaggtggaaagccagatgacatcaccgtccttctttcaatagtggctgagtatacagactagctgaggtgtcaagtcctgcctttcctttcatcatcccaaatttcccctgccatgtgtgctgatcctgctggcaggaccacatttctttgccactgatctcaatggccagtgatgtaagtcttttgcctgtcttcttgagactcgttgagatctttgttgagaaccactactatcattcactagctcatatctgccggcagcaattgaagagatccaatatttgaagattggccttcatttctcgatgttctttccatgatggggatggaggtgttcagtgccaccgtggctgttacttttcaaagtagttgaagtattgaaaatgagtaatgttggtaaagtgaattcaaaatcctagtatgctaaagggatggtacaagtctaacacaaattgtacgtaatgatacatctactagaaacatacattattcatcaaaagaaatgttacatgtgtactccacaggcatagtctttgttatgatgattggtgtggctttatgtctttgttataaactcctatttttcaggggcttatgattctgctctaaaacattgctctgggttatacagttttgatcccaaaagcttttttgttacaaatcgggagaaaaatccattttagttctatggatggaaatatttcatgcttttaaaaagatgtttgtgttcctgtggttaaagttttggcagtttattgattagtccaaatcacaggctaaggcctgatctccaggaggggtaggggagacactttaccagtatttttttatggaaataatactcaaggttgtaaaacccctcaaagcctagaaatttaattgttatggctgaaattcctcctagttgtctgatagaatgcccctgaatgggaactctaggtcccaaggcctgaagggttgagaacagacagctgtaactttgaattttgttggctttcagtggtcatgctacctacccatactcgtactctcagaccttttattagtagccttgctttctatagagcatgcaccaaatccagtgagtccatgtggagagagcactgtgtgcgcagcggcagcagcacagacgtccatgaggaaaactcccagtgatgatctgacatttacaattaccccacatggaaatttaggggtttctgaatcaagcttaatgtttacagtttccaaatagccattttgcagtgtatagtttccttacaaaactaccccgcattcagttttcacattatctgcaagctgaaacttatttttaagttttgtgtacaagttgactgctgtaaagatatatatttttgggtcagtttttttccttcattaacttggtggtagaaaaaaatatatacttagaaatccttaaattaaagccatgttttatatataagtcaggtaacattggtgtatagatgagaatgcaattaaacctgatgagaatctacttgagaatatagaaagtctttctctaaaggagatactgactccctggtttattgcattaaaatttatgtttgaggttacctcaacttgttttaaaagattttgttttgtgaatttgtactgtatatttgagtaactgtcaggcttttatttaaaattgtttaacatgtaccatgtacatgtcattactatatttcaatgcatcatgcttgtaacaggcatttcatttataataagaatgagttattcatttgtaagccgttcagtaatttatctactattcctaaattggcataatgttagataatctattttgaatcacctttaattacatgtcagaatgccttaactaccctaacttgacaaaacagaattctttggtagacgcggtgggggcggggtggggggtctggacggagtctctatttaaggagaaatcatcatgctatgataaaacacagaagcatgagtggcaagtggcggggtatttattttgcacaaactatttgcagtctctgtgtatttaaaaagtaaagaaagttgcatccagaagggttttgttagaatgaatacatttatattaggactgacaacttcagctcttttgtttaggttttcaattatttttggtaagagtatgtagccttatgatctggatatattttgcattcattttccaacgcctacatttaattcctggtaagagcagtgctcgtcaagtttctggtttttctctgctctcatttaacccgtcaaacacaatctttgtaaagctagattggtggtgttttatacaacttatttactcagcttacctttttgagaaacgattgttagaaattgacgatgtgtttgttccagtgatactgaaagtagtgggggcaagaattgagtttcacagtggaattggctttggatctggcctatagattagtgacataaaatattttctctattttcccctgttctttttgtgttatgcacttaattttatgactgccgggggggtcagctggagtgctgcttaacaagtatctctcctactctcagtggtcagaggctgtgttggacccatagtagaattttccaggtcacagacccaagcttccatgggttgttactgtgctgtaccacttggtgggtctgattctgaacctgatgtgtgtgttaattatattttaagcaacacacacacacacacacgcctcatgtaatggacttttataacaaaagaaaaaatttggatttctaatttacaaatggcaaattatttatccctctctggatgcaccaaagaccagtaaagtttatagcttttccatctatatttataaagcaatactgtattataaaaatcaatatttttatcacatgcttgaaatttttattttgttgttttaaaatgtgcactctaaacatatcagaaccttatttcttcctatgaacttaagctgcctgcgcacaaaaaaaaaaaaaatttaccaaatggagatgcagtagagtccataggctctaaaaactaaaagaaatgggatgcagggggaacaagttatttgtcctgagttactgtacttgcttgacatggttgttgggtactaaatcacaaaagaatccattccaggtatgcatgtctgggggttgggctgtgtctagattagaaactgggtttcaagctttgcatgatgggagagcgtcctctcctctatcagctgcgtgtgttctggataggacagtagcccggagatggaaaccaccttcagtaccattagcccaccataccaagtaacaagttaggcaggaatcgtgggaatttattgagtcagctttgagtgtttgagagaatgtaaacaagattggctcgaattgtaaacgtttgtactttggatgagttcatggttctttaggtcaccttaataccagctatctttggtagaagctacagcattcagtttctctggaaactgtatcacatttttgcattttaaaaattttacagtatcaaaaaaccaaaatctgcttatgaaacaaaacatgaagcaggacatatttggattctatttatttaaaattaaattctttgcaaaattgaacttctcaactaaaacgtgtccatgtcagaattttaactgttagcaggtagtttgtggcaaagatggctaaataatgaagcaaattagaatctgtgtgtatactaatgagctgctttttttctgttgagactatcattatttgtcttattacccaagaggcaattacctgaatttggatgtctgaattataacttatgcaggaatagttctgtaaatacatttaaataaactgtaaagatatttaataaatatagtatttatactaa

SEQ ID NO: 307066 - DNA, 5643 bp, Homo sapiens
tcttctttccaaacagtttgccgccctaaatccttccagtatattacttggggaggtgtcactagatctgtgtacctctgtttctcattatgtgactccattctggtttcttgcaggtttttgtttaaaggaatggtggcgttatttatttaaaacaggctttaaaagatacggttaaaacagggtagaaaaccctcacgtggcccacctgcaattcctactaacttaacataggtcccgcgtctgaggaatccccctaggtcctaaatctttggcagccaagtcaaaagtgactacgactccgggactataattcccaagagacactgcgtccgcaccctctgcgcatgttcaaccttggtgactgcataaggcagcgacgccaaggggctgggcttgggcctgagcggtgaatcggggcggggctaggggcagggccaggaggtggggtgctgccgcaccgcccggaacacgctagtggagcggaagatggcggcgcggcggcggccgctgcagccgggacttcagttgggctgaggcggaggagccgccgcttctgacctcgctctggctccggtgcgcgcggctgagcgcgtgcgaggccccgcgcgtcgggcaggggcggcggcggccactgcgcgccgccctgaggagcgccccagcggcggcgcgactgcggctgaggagagagccggctccgggcctccgcgtcctcctgctcccccggccccccgcctcctcgggggggcggcgggcgactacggactggtgacggccggctgcggcttcgggaaggacttccgtaagggcctcctcaagaagggcgcgtgctacggggacgacgcgtgcttcgtggcccggcaccgttccgcggacgtgctcggggttgcagatggtgtaggaggctggagagactatggagttgatccatctcaattctcagggactttaatgcggacgtgtgaacgtttagtaaaagaaggacggttcgtacctagtaatcccattggaattctcaccacaagctactgtgagttgctgcaaaataaagtccctttgctcggtagcagcaccgcctgcattgtggtgctggacagaaccagccaccgcttacacacagcaaacctgggcgattcaggcttcctggttgtcaggggtggtgaagtcgtgcaccgatcagatgagcagcagcattacttcaacactccattccagctctcaatcgctccccctgaagccgagggagtcgtcttgagcgacagtccggatgctgctgatagcacgtctttcgatgtccagctaggagacattatcctgacggcaacagatggactctttgacaacatgcctgattatatgattcttcaggagctaaaaaagttaaagaattcaaattatgagagtatacaacagactgccagaagcattgctgagcaagctcatgagctggcctatgacccaaattatatgtcaccttttgcacagtttgcatgtgacaatggattgaatgtgagaggtggaaagccagatgacatcaccgtccttctttcaatagtggctgagtatacagactagctgaggtgtcaagtcctgcctttcctttcatcatcccaaatttcccctgccatgtgtgctgatcctgctggcaggaccacatttctttgccactgatctcaatggccagtgatgtaagtcttttgcctgtcttcttgagactcgttgagatctttgttgagaaccactactatcattcactagctcatatctgccggcagcaattgaagagatccaatatttgaagattggccttcatttctcgatgttctttccatgatggggatggaggtgttcagtgccaccgtggctgttacttttcaaagtagttgaagtattgaaaatgagtaatgttggtaaagtgaattcaaaatcctagtatgctaaagggatggtacaagtctaacacaaattgtacgtaatgatacatctactagaaacatacattattcatcaaaagaaatgttacatgtgtactccacaggcatagtctttgttatgatgattggtgtggctttatgtctttgttataaactcctatttttcaggggcttatgattctgctctaaaacattgctctgggttatacagttttgatcccaaaagcttttttgttacaaatcgggagaaaaatccattttagttctatggatggaaatatttcatgcttttaaaaagatgtttgtgttcctgtggttaaagttttggcagtttattgattagtccaaatcacaggctaaggcctgatctccaggaggggtaggggagacactttaccagtatttttttatggaaataatactcaaggttgtaaaacccctcaaagcctagaaatttaattgttatggctgaaattcctcctagttgtctgatagaatgcccctgaatgggaactctaggtcccaaggcctgaagggttgagaacagacagctgtaactttgaattttgttggctttcagtggtcatgctacctacccatactcgtactctcagaccttttattagtagccttgctttctatagagcatgcaccaaatccagtgagtccatgtggagagagcactgtgtgcgcagcggcagcagcacagacgtccatgaggaaaactcccagtgatgatctgacatttacaattaccccacatggaaatttaggggtttctgaatcaagcttaatgtttacagtttccaaatagccattttgcagtgtatagtttccttacaaaactaccccgcattcagttttcacattatctgcaagctgaaacttatttttaagttttgtgtacaagttgactgctgtaaagatatatatttttgggtcagtttttttccttcattaacttggtggtagaaaaaaatatatacttagaaatccttaaattaaagccatgttttatatataagtcaggtaacattggtgtatagatgagaatgcaattaaacctgatgagaatctacttgagaatatagaaagtctttctctaaaggagatactgactccctggtttattgcattaaaatttatgtttgaggttacctcaacttgttttaaaagattttgttttgtgaatttgtactgtatatttgagtaactgtcaggcttttatttaaaattgtttaacatgtaccatgtacatgtcattactatatttcaatgcatcatgcttgtaacaggcatttcatttataataagaatgagttattcatttgtaagccgttcagtaatttatctactattcctaaattggcataatgttagataatctattttgaatcacctttaattacatgtcagaatgccttaactaccctaacttgacaaaacagaattctttggtagacgcggtgggggcggggtggggggtctggacggagtctctatttaaggagaaatcatcatgctatgataaaacacagaagcatgagtggcaagtggcggggtatttattttgcacaaactatttgcagtctctgtgtatttaaaaagtaaagaaagttgcatccagaagggttttgttagaatgaatacatttatattaggactgacaacttcagctcttttgtttaggttttcaattatttttggtaagagtatgtagccttatgatctggatatattttgcattcattttccaacgcctacatttaattcctggtaagagcagtgctcgtcaagtttctggtttttctctgctctcatttaacccgtcaaacacaatctttgtaaagctagattggtggtgttttatacaacttatttactcagcttacctttttgagaaacgattgttagaaattgacgatgtgtttgttccagtgatactgaaagtagtgggggcaagaattgagtttcacagtggaattggctttggatctggcctatagattagtgacataaaatattttctctattttcccctgttctttttgtgttatgcacttaattttatgactgccgggggggtcagctggagtgctgcttaacaagtatctctcctactctcagtggtcagaggctgtgttggacccatagtagaattttccaggtcacagacccaagcttccatgggttgttactgtgctgtaccacttggtgggtctgattctgaacctgatgtgtgtgttaattatattttaagcaacacacacacacacacacgcctcatgtaatggacttttataacaaaagaaaaaatttggatttctaatttacaaatggcaaattatttatccctctctggatgcaccaaagaccagtaaagtttatagcttttccatctatatttataaagcaatactgtattataaaaatcaatatttttatcacatgcttgaaatttttattttgttgttttaaaatgtgcactctaaacatatcagaaccttatttcttcctatgaacttaagctgcctgcgcacaaaaaaaaaaaaaatttaccaaatggagatgcagtagagtccataggctctaaaaactaaaagaaatgggatgcagggggaacaagttatttgtcctgagttactgtacttgcttgacatggttgttgggtactaaatcacaaaagaatccattccaggtatgcatgtctgggggttgggctgtgtctagattagaaactgggtttcaagctttgcatgatgggagagcgtcctctcctctatcagctgcgtgtgttctggataggacagtagcccggagatggaaaccaccttcagtaccattagcccaccataccaagtaacaagttaggcaggaatcgtgggaatttattgagtcagctttgagtgtttgagagaatgtaaacaagattggctcgaattgtaaacgtttgtactttggatgagttcatggttctttaggtcaccttaataccagctatctttggtagaagctacagcattcagtttctctggaaactgtatcacatttttgcattttaaaaattttacagtatcaaaaaaccaaaatctgcttatgaaacaaaacatgaagcaggacatatttggattctatttatttaaaattaaattctttgcaaaattgaacttctcaactaaaacgtgtccatgtcagaattttaactgttagcaggtagtttgtggcaaagatggctaaataatgaagcaaattagaatctgtgtgtatactaatgagctgctttttttctgttgagactatcattatttgtcttattacccaagaggcaattacctgaatttggatgtctgaattataacttatgcaggaatagttctgtaaatacatttaaataaactgtaaagatatttaataaatatagtatttatactaatctgtgtgcttcttttggtttgaatagtaactaaatgagacaccagcccttgacattgagtttgttggtcactatcaggtcctcatttccaagcctcctagtcattctagcactgattatatgctgctactttaactggctccagctgcttcactacatcagtttagcttcctcagaaattcatcaaaatggacggacaattaaatgtaaattatagaactttttcccagctgaggctttgcaccttccgtatagtatagagggaagctacaaaaa

SEQ ID NO: 307067 - DNA, 5419 bp, Homo sapiens
  misc_feature (5401)..(5401): n is a, c, g, or t
  misc_feature (5416)..(5417): n is a, c, g, or t
tcttctttccaaacagtttgccgccctaaatccttccagtatattacttggggaggtgtcactagatctgtgtacctctgtttctcattatgtgactccattctggtttcttgcaggtttttgtttaaaggaatggtggcgttatttatttaaaacaggctttaaaagatacggttaaaacagggtagaaaaccctcacgtggcccacctgcaattcctactaacttaacataggtcccgcgtctgaggaatccccctaggtcctaaatctttggcagccaagtcaaaagtgactacgactccgggactataattcccaagagacactgcgtccgcaccctctgcgcatgttcaaccttggtgactgcataaggcagcgacgccaaggggctgggcttgggcctgagcggtgaatcggggcggggctaggggcagggccaggaggtggggtgctgccgcaccgcccggaacacgctagtggagcggaagatggcggcgcggcggcggccgctgcagccgggacttcagttgggctgaggcggaggagccgccgcttctgacctcgctctggctccggtgcgcgcggctgagcgcgtgcgaggccccgcgcgtcgggcaggggcggcggcggccactgcgcgccgccctgaggagcgccccagcggcggcgcgactgcggctgaggagagagccggctccgggcctccgcgtcctcctgctcccccggccccccgcctcctcgggggggcggcgggcgactacggactggtgacggccggctgcggcttcgggaaggacttccgtaagggcctcctcaagaagggcgcgtgctacggggacgacgcgtgcttcgtggcccggcaccgttccgcggacgtgctcggggttgcagatggtgtaggaggctggagagactatggagttgatccatctcaattctcagggactttaatgcggacgtgtgaacgtttagtaaaagaaggacggttcgtacctagtaatcccattggaattctcaccacaagctactgtgagttgctgcaaaataaagtccctttgctcggtagcagcaccgcctgcattgtggtgctggacagaaccagccaccgcttacacacagcaaacctgggcgattcaggcttcctggttgtcaggggtggtgaagtcgtgcaccgatcagatgagcagcagcattacttcaacactccattccagctctcaatcgctccccctgaagccgagggagtcgtcttgagcgacagtccggatgctgctgatagcacgtctttcgatgtccagctaggagacattatcctgacggcaacagatggactctttgacaacatgcctgattatatgattcttcaggagctaaaaaagttaaagaattcaaattatgagagtatacaacagactgccagaagcattgctgagcaagctcatgagctggcctatgacccaaattatatgtcaccttttgcacagtttgcatgtgacaatggattgaatgtgagaggtggaaagccagatgacatcaccgtccttctttcaatagtggctgagtatacagactagctgaggtgtcaagtcctgcctttcctttcatcatcccaaatttcccctgccatgtgtgctgatcctgctggcaggaccacatttctttgccactgatctcaatggccagtgatgtaagtcttttgcctgtcttcttgagactcgttgagatctttgttgagaaccactactatcattcactagctcatatctgccggcagcaattgaagagatccaatatttgaagattggccttcatttctcgatgttctttccatgatggggatggaggtgttcagtgccaccgtggctgttacttttcaaagtagttgaagtattgaaaatgagtaatgttggtaaagtgaattcaaaatcctagtatgctaaagggatggtacaagtctaacacaaattgtacgtaatgatacatctactagaaacatacattattcatcaaaagaaatgttacatgtgtactccacaggcatagtctttgttatgatgattggtgtggctttatgtctttgttataaactcctatttttcaggggcttatgattctgctctaaaacattgctctgggttatacagttttgatcccaaaagcttttttgttacaaatcgggagaaaaatccattttagttctatggatggaaatatttcatgcttttaaaaagatgtttgtgttcctgtggttaaagttttggcagtttattgattagtccaaatcacaggctaaggcctgatctccaggaggggtaggggagacactttaccagtatttttttatggaaataatactcaaggttgtaaaacccctcaaagcctagaaatttaattgttatggctgaaattcctcctagttgtctgatagaatgcccctgaatgggaactctaggtcccaaggcctgaagggttgagaacagacagctgtaactttgaattttgttggctttcagtggtcatgctacctacccatactcgtactctcagaccttttattagtagccttgctttctatagagcatgcaccaaatccagtgagtccatgtggagagagcactgtgtgcgcagcggcagcagcacagacgtccatgaggaaaactcccagtgatgatctgacatttacaattaccccacatggaaatttaggggtttctgaatcaagcttaatgtttacagtttccaaatagccattttgcagtgtatagtttccttacaaaactaccccgcattcagttttcacattatctgcaagctgaaacttatttttaagttttgtgtacaagttgactgctgtaaagatatatatttttgggtcagtttttttccttcattaacttggtggtagaaaaaaatatatacttagaaatccttaaattaaagccatgttttatatataagtcaggtaacattggtgtatagatgagaatgcaattaaacctgatgagaatctacttgagaatatagaaagtctttctctaaaggagatactgactccctggtttattgcattaaaatttatgtttgaggttacctcaacttgttttaaaagattttgttttgtgaatttgtactgtatatttgagtaactgtcaggcttttatttaaaattgtttaacatgtaccatgtacatgtcattactatatttcaatgcatcatgcttgtaacaggcatttcatttataataagaatgagttattcatttgtaagccgttcagtaatttatctactattcctaaattggcataatgttagataatctattttgaatcacctttaattacatgtcagaatgccttaactaccctaacttgacaaaacagaattctttggtagacgcggtgggggcggggtggggggtctggacggagtctctatttaaggagaaatcatcatgctatgataaaacacagaagcatgagtggcaagtggcggggtatttattttgcacaaactatttgcagtctctgtgtatttaaaaagtaaagaaagttgcatccagaagggttttgttagaatgaatacatttatattaggactgacaacttcagctcttttgtttaggttttcaattatttttggtaagagtatgtagccttatgatctggatatattttgcattcattttccaacgcctacatttaattcctggtaagagcagtgctcgtcaagtttctggtttttctctgctctcatttaacccgtcaaacacaatctttgtaaagctagattggtggtgttttatacaacttatttactcagcttacctttttgagaaacgattgttagaaattgacgatgtgtttgttccagtgatactgaaagtagtgggggcaagaattgagtttcacagtggaattggctttggatctggcctatagattagtgacataaaatattttctctattttcccctgttctttttgtgttatgcacttaattttatgactgccgggggggtcagctggagtgctgcttaacaagtatctctcctactctcagtggtcagaggctgtgttggacccatagtagaattttccaggtcacagacccaagcttccatgggttgttactgtgctgtaccacttggtgggtctgattctgaacctgatgtgtgtgttaattatattttaagcaacacacacacacacacacgcctcatgtaatggacttttataacaaaagaaaaaatttggatttctaatttacaaatggcaaattatttatccctctctggatgcaccaaagaccagtaaagtttatagcttttccatctatatttataaagcaatactgtattataaaaatcaatatttttatcacatgcttgaaatttttattttgttgttttaaaatgtgcactctaaacatatcagaaccttatttcttcctatgaacttaagctgcctgcgcacaaaaaaaaaaaaaatttaccaaatggagatgcagtagagtccataggctctaaaaactaaaagaaatgggatgcagggggaacaagttatttgtcctgagttactgtacttgcttgacatggttgttgggtactaaatcacaaaagaatccattccaggtatgcatgtctgggggttgggctgtgtctagattagaaactgggtttcaagctttgcatgatgggagagcgtcctctcctctatcagctgcgtgtgttctggataggacagtagcccggagatggaaaccaccttcagtaccattagcccaccataccaagtaacaagttaggcaggaatcgtgggaatttattgagtcagctttgagtgtttgagagaatgtaaacaagattggctcgaattgtaaacgtttgtactttggatgagttcatggttctttaggtcaccttaataccagctatctttggtagaagctacagcattcagtttctctggaaactgtatcacatttttgcattttaaaaattttacagtatcaaaaaaccaaaatctgcttatgaaacaaaacatgaagcaggacatatttggattctatttatttaaaattaaattctttgcaaaattgaacttctcaactaaaacgtgtccatgtcagaattttaactgttagcaggtagtttgtggcaaagatggctaaataatgaagcaaattagaatctgtgtgtatactaatgagctgctttttttctgttgagactatcattatttgtcttattacccaagaggcaattacctgaatttggatgtctgaattataacttatgcaggaatagttctgtaaatacattttgttgaaatgtcccccttgtgattggagtgggtgttgaaaaaaatcaggcgagtagggtcactgggtggggggggggnagaccgccggggggnngg

SEQ ID NO: 307068 - DNA, 5313 bp, Homo sapiens
tcttctttccaaacagtttgccgccctaaatccttccagtatattacttggggaggtgtcactagatctgtgtacctctgtttctcattatgtgactccattctggtttcttgcaggtttttgtttaaaggaatggtggcgttatttatttaaaacaggctttaaaagatacggttaaaacagggtagaaaaccctcacgtggcccacctgcaattcctactaacttaacataggtcccgcgtctgaggaatccccctaggtcctaaatctttggcagccaagtcaaaagtgactacgactccgggactataattcccaagagacactgcgtccgcaccctctgcgcatgttcaaccttggtgactgcataaggcagcgacgccaaggggctgggcttgggcctgagcggtgaatcggggcggggctaggggcagggccaggaggtggggtgctgccgcaccgcccggaacacgctagtggagcggaagatggcggcgcggcggcggccgctgcagccgggacttcagttgggctgaggcggaggagccgccgcttctgacctcgctctggctccggtgcgcgcggctgagcgcgtgcgaggccccgcgcgtcgggcaggggcggcggcggccactgcgcgccgccctgaggagcgccccagcggcggcgcgactgcggctgaggagagagccggctccgggcctccgcgtcctcctgctcccccggccccccgcctcctcgggggggcggcgggcgactacggactggtgacggccggctgcggcttcgggaaggacttccgtaagggcctcctcaagaagggcgcgtgctacggggacgacgcgtgcttcgtggcccggcaccgttccgcggacgtgctcggggttgcagatggtgtaggaggctggagagactatggagttgatccatctcaattctcagggactttaatgcggacgtgtgaacgtttagtaaaagaaggacggttcgtacctagtaatcccattggaattctcaccacaagctactgtgagttgctgcaaaataaagtccctttgctcggtagcagcaccgcctgcattgtggtgctggacagaaccagccaccgcttacacacagcaaacctgggcgattcaggcttcctggttgtcaggggtggtgaagtcgtgcaccgatcagatgagcagcagcattacttcaacactccattccagctctcaatcgctccccctgaagccgagggagtcgtcttgagcgacagtccggatgctgctgatagcacgtctttcgatgtccagctaggagacattatcctgacggcaacagatggactctttgacaacatgcctgattatatgattcttcaggagctaaaaaagttaaagaattcaaattatgagagtatacaacagactgccagaagcattgctgagcaagctcatgagctggcctatgacccaaattatatgtcaccttttgcacagtttgcatgtgacaatggattgaatgtgagaggtggaaagccagatgacatcaccgtccttctttcaatagtggctgagtatacagactagctgaggtgtcaagtcctgcctttcctttcatcatcccaaatttcccctgccatgtgtgctgatcctgctggcaggaccacatttctttgccactgatctcaatggccagtgatgtaagtcttttgcctgtcttcttgagactcgttgagatctttgttgagaaccactactatcattcactagctcatatctgccggcagcaattgaagagatccaatatttgaagattggccttcatttctcgatgttctttccatgatggggatggaggtgttcagtgccaccgtggctgttacttttcaaagtagttgaagtattgaaaatgagtaatgttggtaaagtgaattcaaaatcctagtatgctaaagggatggtacaagtctaacacaaattgtacgtaatgatacatctactagaaacatacattattcatcaaaagaaatgttacatgtgtactccacaggcatagtctttgttatgatgattggtgtggctttatgtctttgttataaactcctatttttcaggggcttatgattctgctctaaaacattgctctgggttatacagttttgatcccaaaagcttttttgttacaaatcgggagaaaaatccattttagttctatggatggaaatatttcatgcttttaaaaagatgtttgtgttcctgtggttaaagttttggcagtttattgattagtccaaatcacaggctaaggcctgatctccaggaggggtaggggagacactttaccagtatttttttatggaaataatactcaaggttgtaaaacccctcaaagcctagaaatttaattgttatggctgaaattcctcctagttgtctgatagaatgcccctgaatgggaactctaggtcccaaggcctgaagggttgagaacagacagctgtaactttgaattttgttggctttcagtggtcatgctacctacccatactcgtactctcagaccttttattagtagccttgctttctatagagcatgcaccaaatccagtgagtccatgtggagagagcactgtgtgcgcagcggcagcagcacagacgtccatgaggaaaactcccagtgatgatctgacatttacaattaccccacatggaaatttaggggtttctgaatcaagcttaatgtttacagtttccaaatagccattttgcagtgtatagtttccttacaaaactaccccgcattcagttttcacattatctgcaagctgaaacttatttttaagttttgtgtacaagttgactgctgtaaagatatatatttttgggtcagtttttttccttcattaacttggtggtagaaaaaaatatatacttagaaatccttaaattaaagccatgttttatatataagtcaggtaacattggtgtatagatgagaatgcaattaaacctgatgagaatctacttgagaatatagaaagtctttctctaaaggagatactgactccctggtttattgcattaaaatttatgtttgaggttacctcaacttgttttaaaagattttgttttgtgaatttgtactgtatatttgagtaactgtcaggcttttatttaaaattgtttaacatgtaccatgtacatgtcattactatatttcaatgcatcatgcttgtaacaggcatttcatttataataagaatgagttattcatttgtaagccgttcagtaatttatctactattcctaaattggcataatgttagataatctattttgaatcacctttaattacatgtcagaatgccttaactaccctaacttgacaaaacagaattctttggtagacgcggtgggggcggggtggggggtctggacggagtctctatttaaggagaaatcatcatgctatgataaaacacagaagcatgagtggcaagtggcggggtatttattttgcacaaactatttgcagtctctgtgtatttaaaaagtaaagaaagttgcatccagaagggttttgttagaatgaatacatttatattaggactgacaacttcagctcttttgtttaggttttcaattatttttggtaagagtatgtagccttatgatctggatatattttgcattcattttccaacgcctacatttaattcctggtaagagcagtgctcgtcaagtttctggtttttctctgctctcatttaacccgtcaaacacaatctttgtaaagctagattggtggtgttttatacaacttatttactcagcttacctttttgagaaacgattgttagaaattgacgatgtgtttgttccagtgatactgaaagtagtgggggcaagaattgagtttcacagtggaattggctttggatctggcctatagattagtgacataaaatattttctctattttcccctgttctttttgtgttatgcacttaattttatgactgccgggggggtcagctggagtgctgcttaacaagtatctctcctactctcagtggtcagaggctgtgttggacccatagtagaattttccaggtcacagacccaagcttccatgggttgttactgtgctgtaccacttggtgggtctgattctgaacctgatgtgtgtgttaattatattttaagcaacacacacacacacacacgcctcatgtaatggacttttataacaaaagaaaaaatttggatttctaatttacaaatggcaaattatttatccctctctggatgcaccaaagaccagtaaagtttatagcttttccatctatatttataaagcaatactgtattataaaaatcaatatttttatcacatgcttgaaatttttattttgttgttttaaaatgtgcactctaaacatatcagaaccttatttcttcctatgaacttaagctgcctgcgcacaaaaaaaaaaaaaatttaccaaatggagatgcagtagagtccataggctctaaaaactaaaagaaatgggatgcagggggaacaagttatttgtcctgagttactgtacttgcttgacatggttgttgggtactaaatcacaaaagaatccattccaggtatgcatgtctgggggttgggctgtgtctagattagaaactgggtttcaagctttgcatgatgggagagcgtcctctcctctatcagctgcgtgtgttctggataggacagtagcccggagatggaaaccaccttcagtaccattagcccaccataccaagtaacaagttaggcaggaatcgtgggaatttattgagtcagctttgagtgtttgagagaatgtaaacaagattggctcgaattgtaaacgtttgtactttggatgagttcatggttctttaggtcaccttaataccagctatctttggtagaagctacagcattcagtttctctggaaactgtatcacatttttgcattttaaaaattttacagtatcaaaaaaccaaaatctgcttatgaaacaaaacatgaagcaggacatatttggattctatttatttaaaattaaattctttgcaaaattgaacttctcaaatggctaaataatgaagcaaattagaatctgtgtgtatactaatgagctgctttttttctgttgagactatcattatttgtcttattacccaagaggcaattacctgaatttggatgtctgaattataacttatgcaggaatagttctgtaaatacatttaaataaactgtaaagatatttaataaatatagtatttatactaa

SEQ ID NO: 307069 - DNA, 412 bp, Homo sapiens
gtaattaactcaaaggttagctcttgggaaaagtggccctctctggatagctgagttttatggattcagttgcattatctctttgtagttttggaaagaactattttgtgaatttcaggaaaataataatagctctggtctttcaaataattagagcacttggaaaaagaagcttcctacccaaggttttcataggctggtagaagtaggaaaagtctagatggagggcatttcttgtttgtatctttatttatattttaatggtgtcgggtcctggttgtttctccttttattcttctaacacccagcaggtgttgaatcaggcaaagacaggaaatagtcatgccagagccagccaaaggcagcaggccactggaagcctcagtgtgacctgagctgccaccagtaacca

SEQ ID NO: 307070 - DNA, 436 bp, Homo sapiens
gcggccgctgcagccgggacttcagttgggctgaggcggaggagccgccgcttctgacctcgctctggctccggtgcgcgcggctgagcgcgtgcgaggccccgcgcgtcgggcaggggcggcggcggccactgcgcgccgccctgaggagcgccccagcggcggcgcgactgcggctgaggagagagccggctccgggcctccgcgtcctcctgctcccccggccccccgcctcctcgggggggcggcggcggcgatgttctcggtcctctcgtacgggcggctggtggcccgcgccgtgctcggcggcctctcgcagaccgaccccagggccggcggcggcggcggcggcgactacggactggtgacggccggctgcggcttcgggaaggacttccgtaagggcctcctcaagaagggcgcgtgctacggggac

SEQ ID NO: 307071 - DNA, 2757 bp, Homo sapiens
  misc_feature (1)..(1): n is a, c, g, or t
natcgcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtg

SEQ ID NO: 307072 - DNA, 768 bp, Homo sapiens
  misc_feature (1)..(1): n is a, c, g, or t
  misc_feature (738)..(738): n is a, c, g, or t
natcgcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatgcctgttaaagaaacccngttgcgttattggcagccaacccaacgggg

SEQ ID NO: 307073 - DNA, 798 bp, Homo sapiens
  misc_feature (1)..(1): n is a, c, g, or t
natcgcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtagtgccttaatttttaaccagtttccaataaaacggtttactacctgcgtgtg

SEQ ID NO: 307074 - DNA, 777 bp, Homo sapiens
  misc_feature (1)..(1): n is a, c, g, or t
natcgcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggaccgggaaccgagatgaagacaagacttgatgaaaatccgaatattgcctggttaaagaagcgacacttccctttgaagtgacaccttcgcaaacccccggt

SEQ ID NO: 307075 - DNA, 1787 bp, Homo sapiens
gcgctgggctcggcgggcggcctgggcccacggtcgcaggcagcgccccgacggaggctcctcgagggtcacgcccgtttggcggccgcgggagctgccgtcgcggctggggcgcgggcaggggaagagccgtctttgtctttgtctttgttttgtccagtcgctgcggccgctcctcgcgcgtggcctcgggttggccctcgcccggcaggcgggacgcttggcacctgcggcctcccttagcctcactgcgaccccaaacagcactcctcgggttcgatcccgagccgggaagccggctcacgacgtgttcgaggtcgcacagctggtcgggggcaggccgggatggcggccgcaggcccctgcagggtgatggggccgcggccggtgtgtctctacagccgccggcgttcacgccgccactccctcccggccgcagttccacgcacagcagcgaacgctcgcacttatgccttagaaaggaaggcgtccccaaagccaggctgtagcatctgattttgaagcaagctgattgcggttctacgctgtccagacgcgcaggtggcattcttcatcgtttatcccgtctgcgccaggccctgcggccacagtggtgaccgacagccagagctcctatccaagaggagctgagtccccgggaggctgaccaagaaagaagcagtgagggcgcgggggctgggggaggaaagtgcatgacaggagactcagagttccagaaaccggcagtgtttatagagggtggcttcctgtggggctgggcctccagggcctggtgggctgcgggaaaatccagcaggttctaagctggagagtgtcatggttggacctgtttcacaatgtcatgctggcttccgtgtgtggagtttccaggtgaccactagtggtggggaatagtgccaccttaacttcagtttcctgacccttacaattagggttgacctgggcccagcttgaggggctaatacttttctcagctcttgttagcccaggctctgtcagtgtctgtttagcatagtagagcaccttttctttttgtgaccttatggaatgtttattccgatgcaggattatttgtgtttcttcttacctgcctccaagtgtgcttagggtttgtgacgttagcaatgcagctgccttgaagtttgttagtcaaggaggccagtgggactgtactgggaacttttggcccagattgagttctaagcgcaaatgtgcagtgaatacgtttccacaaacagaatgggcgtctgcaggcagagtgtgtgattcactggcaactgtatcagtggctcgggggtgtgtttgcttgcattgtgaaagcgggagtgtcaggaaaacaaccatgaggttttgtttgactgtgattcctcctgctctgcactgctgaagggtgcagagatgggtgtggacgagtggagtggacagtgtgggaattaatccggaactgccattcggtgtgtcagctgaaaagccattcggtgtgtctgcacttggaggctgcacttgcttgcttccacttatggtaatcaccaagtcctggtgggtggactgttgtttctctcactggggaccccttggaataggaagaatggtgccgtgtcatgttggcattcactgcccaggcgcctttggtgtctgcgtgccccttgtccttggagagaggggctatttatagcctggagaactcccctcttcccacagagtacttgcttggtgtgagatttttactgcttgtcatggttacaggaatgtgaccgcagtactga

SEQ ID NO: 307076 - DNA, 986 bp, Homo sapiens
  misc_feature (1)..(1): n is a, c, g, or t
  misc_feature (503)..(503): n is a, c, g, or t
  misc_feature (517)..(517): n is a, c, g, or t
  misc_feature (528)..(528): n is a, c, g, or t
  misc_feature (536)..(536): n is a, c, g, or t
  misc_feature (546)..(546): n is a, c, g, or t
  misc_feature (567)..(567): n is a, c, g, or t
  misc_feature (575)..(575): n is a, c, g, or t
  misc_feature (583)..(584): n is a, c, g, or t
  misc_feature (597)..(597): n is a, c, g, or t
  misc_feature (612)..(612): n is a, c, g, or t
  misc_feature (614)..(615): n is a, c, g, or t
  misc_feature (621)..(621): n is a, c, g, or t
  misc_feature (623)..(623): n is a, c, g, or t
  misc_feature (626)..(626): n is a, c, g, or t
  misc_feature (628)..(628): n is a, c, g, or t
  misc_feature (657)..(657): n is a, c, g, or t
  misc_feature (662)..(662): n is a, c, g, or t
  misc_feature (676)..(676): n is a, c, g, or t
  misc_feature (680)..(680): n is a, c, g, or t
  misc_feature (682)..(682): n is a, c, g, or t
  misc_feature (697)..(697): n is a, c, g, or t
  misc_feature (706)..(706): n is a, c, g, or t
  misc_feature (853)..(853): n is a, c, g, or t
  misc_feature (909)..(910): n is a, c, g, or t
  misc_feature (913)..(913): n is a, c, g, or t
  misc_feature (916)..(916): n is a, c, g, or t
  misc_feature (935)..(935): n is a, c, g, or t
natcgcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggncgtgaactttgagncgctgatcatnaccatgtngcgctagctngggggaaaataataatgcgcnaattgcanatatgatnntgatgcatgcatnaaggcagcgcagcancnnaagccnanaancnaaggcgctgcgcgcgcagcgcaaatgagngcgangcgcgggcgcgcgnggcntnaggcagcgcgcgcanaggcgcagnagcagcatgcaagcaaaagcaaatgcatgcaaataagcaaaaaaaaatatgcgcaatgctttaagagcaagcaaaaaaaaagctaatgcatagcattttgcaaaaaaaaaataaaagcagcataaaagcaaaaataagctaaaagcnagcattaaatgctgcgcgctgcaaaaaataaagcaagcaaaaagcaaaaagcaagnngcngcnaaaaagctggcaaaattgngcgctataaatgcgaaattgcgcaaagctgcgaaaatgcaaagaaattaaa

SEQ ID NO: 307077 - DNA, 996 bp, Homo sapiens
gcgctgggctcggcgggcggcctgggcccacggtcgcaggcagcgccccgacggaggctcctcgagggtcacgcccgtttggcggccgcgggagctgccgtcgcggctggggcgcgggcaggggaagagccgtctttgtctttgtctttgttttgtccagtcgctgcggccgctcctcgcgcgtggcctcgggttggccctcgcccggcaggcgggacgcttggcacctgcggcctcccttagcctcactgcgaccccaaacagcactcctcgggttcgatcccgagccgggaagccggctcacgacgtgttcgaggtcgcacagctggtcgggggcaggccgggatggcggccgcaggcccctgcagggtgatggggccgcggccggtgtgtctctacagccgccggcgttcacgccgccactccctcccggccgcagttccacgcacagcagcgaacgctcgcacttatgccttagaaaggaaggcgtccccaaagccaggctgtagcatctgattttgaagcaagctgattgcggttctacgctgtccagacgcgcagcgggattcctgaacactcgttccacatgtcttgaagaaggcttgttatcagcaggggctcaggaagaggaccttcatttgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacgggtgaggtggtggtgatgccc

SEQ ID NO: 307078 - DNA, 220 bp, Homo sapiens
ccagaagaaacctggcgcccccactgagggacacggaagggcgtgtctagcagttacaccaccgtgcgctgtcgtttggtgctcataatgttcctctgtgttttaggagagcagagatgaagacaagacatgatgaaatcagaaaaaaatatgatggtaaggactggtcacgcctcctttttgtctggttgggaggcgatggcacgctgtctcggtcctc

SEQ ID NO: 307079 - DNA, 2704 bp, Homo sapiens
  misc_feature (1)..(1): n is a, c, g, or t
natcgcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccatcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtg

SEQ ID NO: 307080 - DNA, 2703 bp, Homo sapiens
  misc_feature (1)..(1): n is a, c, g, or t
natcgcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaattttttataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtg

SEQ ID NO: 307081 - DNA, 2723 bp, Homo sapiens
  misc_feature (1)..(1): n is a, c, g, or t
natcgcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtg

SEQ ID NO: 307082 - DNA, 2572 bp, Homo sapiens
  misc_feature (1)..(1): n is a, c, g, or t
natcgcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagcttctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtg

SEQ ID NO: 307083 - DNA, 2837 bp, Homo sapiens
  misc_feature (1)..(1): n is a, c, g, or t
natcgcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcgggattcctgaacactcgttccacatgtcttgaagaaggcttgttatcagcaggggctcaggaagaggaccttcatttgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtg

SEQ ID NO: 307084 - DNA, 3058 bp, Homo sapiens
gcgctgggctcggcgggcggcctgggcccacggtcgcaggcagcgccccgacggaggctcctcgagggtcacgcccgtttggcggccgcgggagctgccgtcgcggctggggcgcgggcaggggaagagccgtctttgtctttgtctttgttttgtccagtcgctgcggccgctcctcgcgcgtggcctcgggttggccctcgcccggcaggcgggacgcttggcacctgcggcctcccttagcctcactgcgaccccaaacagcactcctcgggttcgatcccgagccgggaagccggctcacgacgtgttcgaggtcgcacagctggtcgggggcaggccgggatggcggccgcaggcccctgcagggtgatggggccgcggccggtgtgtctctacagccgccggcgttcacgccgccactccctcccggccgcagttccacgcacagcagcgaacgctcgcacttatgccttagaaaggaaggcgtccccaaagccaggctgtagcatctgattttgaagcaagctgattgcggttctacgctgtccagacgcgcagcgggattcctgaacactcgttccacatgtcttgaagaaggcttgttatcagcaggggctcaggaagaggaccttcatttgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtg

SEQ ID NO: 307085 - DNA, 2704 bp, Homo sapiens
  misc_feature (1)..(1): n is a, c, g, or t
natcgcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgtgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtg

SEQ ID NO: 307086 - DNA, 2570 bp, Homo sapiens
agtgcagttgtgaaggtcagaggtaggaagcatggtccttgctacagatggtgaccatgctcacccaagtccattcaacacaaactcagtgagtgcctgtgatgggccaggctgtgtcctgtgttcttgggagacttcagccagtgaagtgcacaggtgcccggcgtgtggggaggagaggtctacggaagcaaacctcacaggagtgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtg

SEQ ID NO: 307087 - DNA, 2704 bp, Homo sapiens
  misc_feature (1)..(1): n is a, c, g, or t
natcgcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgagctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtg

SEQ ID NO: 307088 - DNA, 2710 bp, Homo sapiens
  misc_feature (1)..(1): n is a, c, g, or t
natcgcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtg

SEQ ID NO: 307089 - DNA, 2707 bp, Homo sapiens
  misc_feature (1)..(1): n is a, c, g, or t
natcgcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtg

SEQ ID NO: 307090 - DNA, 2137 bp, Homo sapiens
cgccgctggctgttccggtgcggaggagacggctggatacggcagtgaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtg

SEQ ID NO: 307091 - DNA, 2538 bp, Homo sapiens
  misc_feature (1)..(1): n is a, c, g, or t
natcgcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttggggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtg

SEQ ID NO: 307092 - DNA, 2382 bp, Homo sapiens
agtaaggttattttgtttaatagtagccatccactgtggaactagccaaccactgtggaaagaaatacttgccttaaatttcttttcttcgccgagcatcaggaagtaagtgcttatctcttaggatctgttagagttcttgtttctagtaaattttatttcagttttaaagtttaaagtggtttgacttcaaaaaaggttaagcactgtatgagagcctgcttacaacgcccgttgttgctatagcctcagtaaatcttcttataaagcttggtttgtatggctttctaagattttgtttctggttgaatgaatgaagttatgattcaagtttattttgtttcaggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtg

SEQ ID NO: 307093 - DNA, 3061 bp, Homo sapiens
  misc_feature (1)..(1): n is a, c, g, or t
  misc_feature (2769)..(2769): n is a, c, g, or t
natcgcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtgaaaaaaaaaaanaaaaaaaaaaaaaaaaaaaaaaagggggggggggcaaaaattttaccccgcggaggggcccaagataagcggcgtcacccgagtttttctgtgtacaaagggggcgccctatagggagagcaggaattaaaaagacaaagccagggggccgcggtaaaaccacgtgcgtggggggaacacggctacagtggggactctgggcaagagacctcaatgcgggcgcggcactcaagcgccacctactcacgagtgagatcaggaattcacttcaggttaggaacacggtagcggg

SEQ ID NO: 307094 - DNA, 2742 bp, Homo sapiens
  misc_feature (1)..(1): n is a, c, g, or t
natcgcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggaatagctgctgtagttgcttggaatagctgtgtagttg

SEQ ID NO: 307095 - DNA, 2735 bp, Homo sapiens
  misc_feature (1)..(1): n is a, c, g, or t
natcgcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtg

SEQ ID NO: 307096 - DNA, 1480 bp, Homo sapiens
gcgggcgactagaggaccctcacccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtg

SEQ ID NO: 307097 - DNA, 1413 bp, Homo sapiens
  misc_feature (56)..(56): n is a, c, g, or t
tggtcgagtaagtgtctactcatgtataatagatgggatagtattaaaaaattatnggtgtctcctgttaaagattcacagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtg

SEQ ID NO: 307098 - DNA, 2684 bp, Homo sapiens
  misc_feature (1)..(1): n is a, c, g, or t
natcgcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaatagtacataaggagagttggttgactttaacagaatatggtcactccaagagaagttagtgtgggtggggaagtgcaaggttaagaaacagcaaagtcactggagacatatcgtgtcacagcaatatcacagatcaaatccagaagatgaaaaatctcttcctgctttactacctgccatgccaaaaaccacttagcaaatacgaaaacagacctggccgggcacagtggctcacgcttgtaatcccagca

SEQ ID NO: 307099 - DNA, 2387 bp, Homo sapiens
  misc_feature (1)..(1): n is a, c, g, or t
natcgcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctagcctgaagaactgggtacaggttctattattgtggaaatttcagcctaggaatgttattcccggtcagatggccgggttccta

SEQ ID NO: 307100 - DNA, 2276 bp, Homo sapiens
  misc_feature (1)..(1): n is a, c, g, or t
natcgcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgaacccagtgtggagatcctctagagtcaccc

SEQ ID NO: 307101 - DNA, 2193 bp, Homo sapiens
  misc_feature (1)..(1): n is a, c, g, or t
natcgcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggaggctttattctgcaagcaatcaaataataaatctattctgctaagagatcacaa

SEQ ID NO: 307102 - DNA, 1306 bp, Homo sapiens
  misc_feature (484)..(484): n is a, c, g, or t
ggccgggctccttgtgcttcctggaaagggattgtgccattctagcacccttcacgcgatccaggaatcctctcttcaaacctgtccctgtccacaggcccgatgagcgcgttggaggatcgataggagggggcaataacctagaattggagaccccaggagggcttctctgaggatgtgcacgttcaggatcccccagatggagaaatgggaaggaacttgatcggggtgaaggaaccgcttgagcaaaggcaggaaggagtgtcggcgcccttcattctggaagttcctccttgctttcaggactcagtttcctgggttccccttcacggcccctcatctccttacagtccagggtctgagggtctccgcggtcccctccttactcagtcacgccattcttttgaaacgtacacgtgaccgcggcacttcttaaggagcgccccccttttcctcggtggctttcagtttcctcacctcccgnggagaccacggccatggtcatttatccacttgacaaacatttcacgagcccctgccggtccaagctgtggggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtg

SEQ ID NO: 307103 - DNA, 1248 bp, Homo sapiens
  misc_feature (1)..(1): n is a, c, g, or t
natcgcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgccaaagatttcttatttcaagtgactaaatctggcttcactgctcaggtgattatcctgaacatccaggcaaataagcgcgggctatgcccctga

SEQ ID NO: 307104 - DNA, 1329 bp, Homo sapiens
  misc_feature (1)..(1): n is a, c, g, or t
natcgcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccaggggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtg

SEQ ID NO: 307105 - DNA, 845 bp, Homo sapiens
  misc_feature (1)..(1): n is a, c, g, or t
natcgcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaaactgtaacctcaaggaaaccataaagcttggagtgccttaatttttaaccagtttccaataaaacggtttactacctgcgtgtg

SEQ ID NO: 307106 - DNA, 808 bp, Homo sapiens
  misc_feature (1)..(1): n is a, c, g, or t
natcgcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatgaaaactgtaacctcaaggaaaccataaagcttggagtgccttaatttttaaccagtttccaataaaacggtttactacctgcgtgtg

SEQ ID NO: 307107 - DNA, 352 bp, Homo sapiens
cagttattgaatcccaggcgtccaaaagtggattatgtctcagtctttcattgggcgacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtg

SEQ ID NO: 307108 - DNA, 229 bp, Homo sapiens
tgttttatgaagatgaaacagggtggtgtgttagagtcatgactggggtgagggagggctgctctagattggaggtcagggatggctactccaggagctgatatttaatctgagaggagcagtgatgaggaactaccctctaacatcctggagaggaaccttccagtagagggaagggggcattcacttggcttgttcaaggagcagagagagggccaaggcagcacag

SEQ ID NO: 307109 - DNA, 3696 bp, Homo sapiens
cctcagactgaggcttggagacaggagcattccactcgccacttcggcgcgcccccatgccctcttgtgcgcgtgcgcagaggcggaccgcaaggctagggcgtgagggaagggcgggcgtacgcccttgcgtgcgtctcaggcagcgcgcacgccggcgtgagagggcacggggaaaaggtggctctggccggggtggctcggtttcctggggctatgtaactgagctcgtcgacttaggggtccttcttcgctgccctcgccgcgtgctagcagggagtttccgctcgggagagagactgtcctcacgcccgctgcgcctcctcgacggcagagcaggcttgctcgcccgtgggagcgtcccggccgagaagccctgaggggggaggggaggccattttgtcccgaccgactccccggaaccgggcggagcggctgggagaggctgcggagccgcggtcgccgccctcggaggcactggacgccgccactgtcggggcttcctcaaagctgttcgtaggtcgcccgcgccgtctcgagcctttttcccacgcttccccggtcctccggcctgagaacgcccgagtgaggagttggccgtagtgagagggaccgatcccttggggccgccggcggcgagagcccgagccgctcctcccaatggcgaagaagacgtacgacctgcttttcaagctgctcctgatcggggattccggagtggggaagacctgcgtcctttttcgtttttcggatgatgccttcaatactacctttatttccaccataggaatagacttcaagatcaaaacagttgaattacaaggaaagaagatcaagctacagatatgggatacagcaggccaggagcgatttcacaccatcacaacctcctactacagaggcgcaatgggtatcatgctagtatatgacatcaccaatggtaaaagttttgaaaacatcagcaaatggcttagaaacatagatgagcatgccaatgaagatgtggaaagaatgttactaggaaacaagtgtgatatggacgacaaaagagttgtacctaaaggaaaaggagaacagattgcaagggagcatggtattaggttttttgagactagtgcaaaagcaaatataaacatcgaaaaggcgttcctcacgttagctgaagatatccttcgaaagacccctgtaaaagagcccaacagtgaaaatgtagatatcagcagtggaggaggcgtgacaggctggaagagcaaatgctgctgagcattctcctgttccatcagttgccatccactaccccgttttctcttcttgctgcaaaataaaccactctgtccatttttaactctaaacagatatttttgtttctcatcttaactatccaagccacctattttatttgttctttcatctgtgactgcttgctgactttatcataattttcttcaaacaaaaaaatgtatagaaaaatcatgtctgtgacttcatttttaaatgtacttgctcagctcaactgcatttcagttgtattatagtccagttcttatcaacattaaaacctatagcaatcatttcaaatctattctgcaaattgtataagaataaagttagaattaacaattttattttgtacaacagtggaattttctgtcatggataatgtgcttgagtccctataatctatagacatgtgatagcaaaagaaacaaacaaaagccaggaaaacactcattttcgccttgaatatgtaaatgggattaattttgtcctgtgccttatgtggaaaggaacttctttggttttccttttttgttctggtggaagcatgtgcaggagacatatcatccaaacataaaccattaaaatgtttgtggtttgcttggctgtaattttcaaagtagttaattgaggacaaagggtaatgcagaagtgatagctttggtttgctgagtcttgttttaagtggccttgatatttaaaactattcctgccaccatttcttctccttggccacttcttccttgcgtctccctgcatgctgctttatttgcttctccctccccaaccacctcatggtatatttaagagtgaaagggacaaactagtaggtttgtcaagtttaatataaagcactgatgtaacttgctaggtaaacggaaagataagttctaactgcctactatccaatgtcagttaattggtgtcttcccccctcatttgctctcttccctaaaatgtgtcccagatgccttcatttgctgttttacttctatgttctgcttttcctcctctctttgttcccttcctgtctatccattgagtttatgaaatggaagagttaactgcatgcactagtgtttggagggtgttgtggtttgtctttctaattaggtgtatagcctattcactttcctagaataaatctcttaacctaaatttgagtagtctgcattttggcaactcctctagcagcttggtagcctagtacaggttgtttttttaaaaaaggaaaagcaggaaggaggagtgaattttattaacatgtttgccaaatgtattgagatttggcctctgaagaacactttttcagtgttaagtttctttaccttaagattcagaaatactttagaatattattaattttaagtcctgtctttacatccttttggaaaacttgtattaccatgagtttggaaaaaggacaacgaaaggcttttcatgtaaagataagatctttagctatctctaaccctgtccttttttcactgcattttttctagttttgcttcattgcttatcattaggatagggtaagtgaagtttgctatgctgctagcatcctaagatgatacctttgttgaaagaattgtgaatagcatgattcatttctagcagaggctgagtttaggacagcagcttccattgagaagtctttctgtgtcgtgaatagcattttaatgacctcttggctcacataagcaaacaacatagggacgtatctgctatgaaaatccacaaatttttcagatagtgccctaaaaacaattttatatgcctcactggttgttattcttaggttattcccacacttgactttatcattgtttactactagtaaaaagcagcattgccaaataatccctaattttccactaaaaatataatgaaatgatgttaagctttttgaaaagtttaggttaaacctactgttgttagattaatgtatttgttgcttccctttatctggaatgtggcattagcttttttattttaaccctctttaattcttattcaattccatgacttaaggttggagagctaaacactgggatttttggataacagactgacagttttgcataattataatcggcattgtacatagaaaggatatggctaccttttgttaaatctgcactttctaaatatcaaaaaagggaaatgaagtataaatcaatttttgtataatctgtttgaaacatgagttttatttgcttaatattagggctttgccccttttctgtaagtctcttgggatcctgtgtagaagctgttctcattaaacaccaaacagttaagtccattctctggtactagctacaaattcggtttcatattctacttaacaatttaaataaactgaaatatttctagatggtctacttctgttcatataaaaacaaaacttgatttcca

SEQ ID NO: 307110 - DNA, 3653 bp, Homo sapiens
cctcagactgaggcttggagacaggagcattccactcgccacttcggcgcgcccccatgccctcttgtgcgcgtgcgcagaggcggaccgcaaggctagggcgtgagggaagggcgggcgtacgcccttgcgtgcgtctcaggcagcgcgcacgccggcgtgagagggcacggggaaaaggtggctctggccggggtggctcggtttcctggggctatgtaactgagctcgtcgacttaggggtccttcttcgctgccctcgccgcgtgctagcagggagtttccgctcgggagagagactgtcctcacgcccgctgcgcctcctcgacggcagagcaggcttgctcgcccgtgggagcgtcccggccgagaagccctgaggggggaggggaggccattttgtcccgaccgactccccggaaccgggcggagcggctgggagaggctgcggagccgcggtcgccgccctcggaggcactggacgccgccactgtcggggcttcctcaaagctgttcgtaggtcgcccgcgccgtctcgagcctttttcccacgcttccccggtcctccggcctgagaacgcccgagtgaggagttggccgtagtgagagggaccgatcccttggggccgccggcggcgagagcccgagccgctcctcccaatggcgaagaagacgtacgacctgcttttcaagctgctcctgatcggggattccggagtggggaagacctgcgtcctttttcgtttttcggatgatgccttcaatactacctttatttccaccataggaatagacttcaagatcaaaacagttgaattacaaggaaagaagatcaagctacagatatgggatacagcaggccaggagcgatttcacaccatcacaacctcctactacagaggcgcaatgggtatcatgctagtatatgacatcaccaatggtaaaagttttgaaaacatcagcaaatggcttagaaacatagatgagcatgccaatgaagatgtggaaagaatgttactaggaaacaagtgtgatatggacgacaaaagagttgtacctaaaggaaaaggagaacagattgcaagggagcatggtattaggttttttgagactagtgcaaaagcaaatataaacatcgaaaaggcgttcctcacgttagctgaagatatccttcgaaagacccctgtaaaagagcccaacagtgaaaatgtagatatcagcagtggaggaggcgtgacaggctggaagagcaaatgctgctgagcattctcctgttccatcagttgccatccactaccccgttttctcttcttgctgcaaaataaaccactctgtccatttttaactctaaacagatatttttgtttctcatcttaactatccaagccacctattttatttgttctttcatctgtgactgcttgctgactttatcataattttcttcaaacaaaaaaatgtatagaaaaatcatgtctgtgacttcatttttaaatgtacttgctcagctcaactgcatttcagttgtattatagtccagttcttatcaacattaaaacctatagcaatcatttcaaatctattctgcaaattgtataagaataaagttagaattaacaattttattttgtacaacagtggaattttctgtcatggataatgtgcttgagtccctataatctatagacatgtgatagcaaaagaaacaaacaaaagccaggaaaacactcattttcgccttgaatatgtaaatgggattaattttgtcctgtgccttatgtggaaaggaacttctttggttttccttttttgttctggtggaagcatgtgcaggagacatatcatccaaacataaaccattaaaatgtttgtggtttgcttggctgtaattttcaaagtagttaattgaggacaaagggtaatgcagaagtgatagctttggtttgctgagtcttgttttaagtggccttgatatttaaaactattcctgccaccatttcttctccttggccacttcttccttgcgtctccctgcatgctgctttatttgcttctccctccccaaccacctcatggtatatttaagagtgaaagggacaaactagtaggtttgtcaagtttaatataaagcactgatgtaacttgctaggtaaacggaaagataagttctaactgcctactatccaatgtcagttaattggtgtcttcccccctcatttgctctcttccctaaaatgtgtcccagatgccttcatttgctgttttacttctatgttctgcttttcctcctctctttgttcccttcctgtctatccattgagtttatgaaatggaagagttaactgcatgcactagtgtttggagggtgttgtggtttgtctttctaattaggtgtatagcctattcactttcctagaataaatctcttaacctaaatttgagtagtctgcattttggcaactcctctagcagcttggtagcctagtacaggttgtttttttaaaaaaggaaaagcaggaaggaggagtgaattttattaacatgtttgccaaatgtattgagatttggcctctgaagaacactttttcagtgttaagtttctttaccttaagattcagaaatactttagaatattattaattttaagtcctgtctttacatccttttggaaaacttgtattaccatgagtttggaaaaaggacaacgaaaggcttttcatgtaaagataagatctttagctatctctaaccctgtccttttttcactgcattttttctagttttgcttcattgcttatcattaggatagggtaagtgaagtttgctatgctgctagcatcctaagatgatacctttgttgaaagaattgtgaatagcatgattcatttctagcagaggctgagtttaggacagcagcttccattgagaagtctttctgtgtcgtgaatagcattttaatgacctcttggctcacataagcaaacaacatagggacgtatctgctatgaaaatccacaaatttttcagatagtgccctaaaaacaattttatatgcctcactggttgttattcttaggttattcccacacttgactttatcattgtttactactagtaaaaagcagcattgccaaataatccctaattttccactaaaaatataatgaaatgatgttaagctttttgaaaagtttaggttaaacctactgttgttagattaatgtatttgttgcttccctttatctggaatgtggcattagcttttttattttaaccctctttaattcttattcaattccatgacttaaggttggagagctaaacactgggatttttggataacagactgacagttttgcataattataatcggcattgtacatagaaaggatatggctaccttttgttaaatctgcactttctaaatatcaaaaaagggaaatgaagtataaatcaatttttgtataatctgtttgaaacatgagttttatttgcttaatattagggctttgccccttttctgtaagtctcttgggatcctgtgtagaagctgttctcattaaacaccaaacagttaagtccattctctggtactagctacaaattcggtttcatattctacttaacaatttaaataaactgaaatatttcta

SEQ ID NO: 307111 - DNA, 1073 bp, Homo sapiens
cctcagactgaggcttggagacaggagcattccactcgccacttcggcgcgcccccatgccctcttgtgcgcgtgcgcagaggcggaccgcaaggctagggcgtgagggaagggcgggcgtacgcccttgcgtgcgtctcaggcagcgcgcacgccggcgtgagagggcacggggaaaaggtggctctggccggggtggctcggtttcctggggctatgtaactgagctcgtcgacttaggggtccttcttcgctgccctcgccgcgtgctagcagggagtttccgctcgggagagagactgtcctcacgcccgctgcgcctcctcgacggcagagcaggcttgctcgcccgtgggagcgtcccggccgagaagccctgaggggggaggggaggccattttgtcccgaccgactccccggaaccgggcggagcggctgggagaggctgcggagccgcggtcgccgccctcggaggcactggacgccgccactgtcggggcttcctcaaagctgttcgtaggtcgcccgcgccgtctcgagcctttttcccacgcttccccggtcctccggcctgagaacgcccgagtgaggagttggccgtagtgagagggaccgatcccttggggccgccggcggcgagagcccgagccgctcctcccaatggcgaagaagacgtacgacctgcttttcaagctgctcctgatcggggattccggagtggggaagacctgcgtcctttttcgtttttcggatgatgccttcaatactacctttatttccaccataggaatagacttcaagatcaaaacagttgaattacaaggaaagaagatcaagctacagatatgcatgccaatgaagatgtggaaagaatgttactaggaaacaagtgtgatatggacgacaaaagagttgtacctaaaggaaaaggagaacaggtaaaaatctgaattaaactgatactctgctctgtctttgtaaaggtaatgctacttttgattatttttatagtaatagtgatcgaacacactaagctaattacatagtttttaaaatgcttgttggaaataata

SEQ ID NO: 307112 - DNA, 1041 bp, Homo sapiens
cctcagactgaggcttggagacaggagcattccactcgccacttcggcgcgcccccatgccctcttgtgcgcgtgcgcagaggcggaccgcaaggctagggcgtgagggaagggcgggcgtacgcccttgcgtgcgtctcaggcagcgcgcacgccggcgtgagagggcacggggaaaaggtggctctggccggggtggctcggtttcctggggctatgtaactgagctcgtcgacttaggggtccttcttcgctgccctcgccgcgtgctagcagggagtttccgctcgggagagagactgtcctcacgcccgctgcgcctcctcgacggcagagcaggcttgctcgcccgtgggagcgtcccggccgagaagccctgaggggggaggggaggccattttgtcccgaccgactccccggaaccgggcggagcggctgggagaggctgcggagccgcggtcgccgccctcggaggcactggacgccgccactgtcggggcttcctcaaagctgttcgtaggtcgcccgcgccgtctcgagcctttttcccacgcttccccggtcctccggcctgagaacgcccgagtgaggagttggccgtagtgagagggaccgatcccttggggccgccggcggcgagagcccgagccgctcctcccaatggcgaagaagacgtacgacctgcttttcaagctgctcctgatcggggattccggagtggggaagacctgcgtcctttttcgtttttcggatgatgccttcaatactacctttatttccaccatagaataggacttaagatcaaaacagtttgattacaagggaagaagatcaagctccccatttgggatacaccggccaaggagcgattttacaccattacaacccttctactacaaaggcgccatggggattaaggcttgggtttgaccttacccatgggtaaaggttttgaaacacttacccaatgccttttaaccataaatggacccttgcccatatttggaaggatgtgtcctaggcggggggttttggccctcc

SEQ ID NO: 307113 - DNA, 535 bp, Homo sapiens
  misc_feature (394)..(394): n is a, c, g, or t
cctcagactgaggcttggagacaggagcattccactcgccacttcggcgcgcccccatgccctcttgtgcgcgtgcgcagaggcggaccgcaaggctagggcgtgagggaagggcgggcgtacgcccttgcgtgcgtctcaggcagcgcgcacgccggcgtgagagggcacggggaaaaggtggctctggccggggtggctcggtttcctggggctatgtaactgagctcgtcgacttaggggtccttcttcgctgccctcgccgcgtgctagcagggagtttccgctcgggagagagactgtcctcacgcccgctgcgcctcctcgacggcagagcaggcttgctcgcccgtgggagcgtcccggccgagaagccctgaggggggaggggttntttttataataaaaatatattattgtgaaaattgttgttgttgaagttatagattttatttatctgtgtataattataattttatgtaagtgtaatttgatattagtgtatggtggatgtggttttttgagatatttttaa

SEQ ID NO: 307114 - DNA, 3599 bp, Homo sapiens
cctcagactgaggcttggagacaggagcattccactcgccacttcggcgcgcccccatgccctcttgtgcgcgtgcgcagaggcggaccgcaaggctagggcgtgagggaagggcgggcgtacgcccttgcgtgcgtctcaggcagcgcgcacgccggcgtgagagggcacggggaaaaggtggctctggccggggtggctcggtttcctggggctatgtaactgagctcgtcgacttaggggtccttcttcgctgccctcgccgcgtgctagcagggagtttccgctcgggagagagactgtcctcacgcccgctgcgcctcctcgacggcagagcaggcttgctcgcccgtgggagcgtcccggccgagaagccctgaggggggaggggaggccattttgtcccgaccgactccccggaaccgggcggagcggctgggagaggctgcggagccgcggtcgccgccctcggaggcactggacgccgccactgtcggggcttcctcaaagctgttcgtaggtcgcccgcgccgtctcgagcctttttcccacgcttccccggtcctccggcctgagaacgcccgagtgaggagttggccgtagtgagagggaccgatcccttggggccgccggcggcgagagcccgagccgctcctcccaatggcgaagaagacgtacgacctgcttttcaagctgctcctgatcggggattccggagtggggaagacctgcgtcctttttcgtttttcggatgatgccttcaatactacctttatttccaccataggaatagacttcaagatcaaaacagttgaattacaaggaaagaagatcaagctacagatatgggatacagcaggccaggagcgatttcacaccatcacaacctcctactacagaggcgcaatgggtatcatgctagtatatgacatcaccaatggtaaaagttttgaaaacatcagcaaatggcttagaaacatagatgagcatgccaatgaagatgtggaaagaatgttactaggaaacaagtgtgatatggacgacaaaagagttgtacctaaaggaaaaggagaacagattgcaagggagcatggtattaggttttttgagactagtgcaaaagcaaatataaacatcgaaaaggcgttcctcacgttagctgaagatatccttcgaaagacccctgtaaaagagcccaacagtgaaaatgtagatatcagcagtggaggaggcgtgacaggctggaagagcaaatgctgctgagcattctcctgttccatcagttgccatccactaccccgttttctcttcttgctgcaaaataaaccactctgtccatttttaactctaaacagatatttttgtttctcatcttaactatccaagccacctattttatttgttctttcatctgtgactgcttgctgactttatcataattttcttcaaacaaaaaaatgtatagaaaaatcatgtctgtgacttcatttttaaatgtacttgctcagctcaactgcatttcagttgtattatagtccagttcttatcaacattaaaacctatagcaatcatttcaaatctattctgcaaattgtataagaataaagttagaattaacaattttattttgtacaacagtggaattttctgtcatggataatgtgcttgagtccctataatctatagacatgtgatagcaaaagaaacaaacaaaagccaggaaaacactcattttcgccttgaatatgtaaatgggattaattttgtcctgtgccttatgtggaaaggaacttctttggttttccttttttgttctggtggaagcatgtgcaggagacatatcatccaaacataaaccattaaaatgtttgtggtttgcttggctgtaattttcaaagtagttaattgaggacaaagggtaatgcagaagtgatagctttggtttgctgagtcttgttttaagtggccttgatatttctgcatgctgctttatttgcttctccctccccaaccacctcatggtatatttaagagtgaaagggacaaactagtaggtttgtcaagtttaatataaagcactgatgtaacttgctaggtaaacggaaagataagttctaactgcctactatccaatgtcagttaattggtgtcttcccccctcatttgctctcttccctaaaatgtgtcccagatgccttcatttgctgttttacttctatgttctgcttttcctcctctctttgttcccttcctgtctatccattgagtttatgaaatggaagagttaactgcatgcactagtgtttggagggtgttgtggtttgtctttctaattaggtgtatagcctattcactttcctagaataaatctcttaacctaaatttgagtagtctgcattttggcaactcctctagcagcttggtagcctagtacaggttgtttttttaaaaaaggaaaagcaggaaggaggagtgaattttattaacatgtttgccaaatgtattgagatttggcctctgaagaacactttttcagtgttaagtttctttaccttaagattcagaaatactttagaatattattaattttaagtcctgtctttacatccttttggaaaacttgtattaccatgagtttggaaaaaggacaacgaaaggcttttcatgtaaagataagatctttagctatctctaaccctgtccttttttcactgcattttttctagttttgcttcattgcttatcattaggatagggtaagtgaagtttgctatgctgctagcatcctaagatgatacctttgttgaaagaattgtgaatagcatgattcatttctagcagaggctgagtttaggacagcagcttccattgagaagtctttctgtgtcgtgaatagcattttaatgacctcttggctcacataagcaaacaacatagggacgtatctgctatgaaaatccacaaatttttcagatagtgccctaaaaacaattttatatgcctcactggttgttattcttaggttattcccacacttgactttatcattgtttactactagtaaaaagcagcattgccaaataatccctaattttccactaaaaatataatgaaatgatgttaagctttttgaaaagtttaggttaaacctactgttgttagattaatgtatttgttgcttccctttatctggaatgtggcattagcttttttattttaaccctctttaattcttattcaattccatgacttaaggttggagagctaaacactgggatttttggataacagactgacagttttgcataattataatcggcattgtacatagaaaggatatggctaccttttgttaaatctgcactttctaaatatcaaaaaagggaaatgaagtataaatcaatttttgtataatctgtttgaaacatgagttttatttgcttaatattagggctttgccccttttctgtaagtctcttgggatcctgtgtagaagctgttctcattaaacaccaaacagttaagtccattctctggtactagctacaaattcggtttcatattctacttaacaatttaaataaactgaaatatttcta

SEQ ID NO: 307115 - DNA, 4400 bp, Homo sapiens
cctcagactgaggcttggagacaggagcattccactcgccacttcggcgcgcccccatgccctcttgtgcgcgtgcgcagaggcggaccgcaaggctagggcgtgagggaagggcgggcgtacgcccttgcgtgcgtctcaggcagcgcgcacgccggcgtgagagggcacggggaaaaggtggctctggccggggtggctcggtttcctggggctatgtaactgagctcgtcgacttaggggtccttcttcgctgccctcgccgcgtgctagcagggagtttccgctcgggagagagactgtcctcacgcccgctgcgcctcctcgacggcagagcaggcttgctcgcccgtgggagcgtcccggccgagaagccctgaggggggaggggaggccattttgtcccgaccgactccccggaaccgggcggagcggctgggagaggctgcggagccgcggtcgccgccctcggaggcactggacgccgccactgtcggggcttcctcaaagctgttcgtaggtcgcccgcgccgtctcgagcctttttcccacgcttccccggtcctccggcctgagaacgcccgagtgaggagttggccgtagtgagagggaccgatcccttggggccgccggcggcgagagcccgagccgctcctcccaatggcgaagaagacgtacgacctgcttttcaagctgctcctgatcggggattccggagtggggaagacctgcgtcctttttcgtttttcggatgatgccttcaatactacctttatttccaccataggaatagacttcaagatcaaaacagttgaattacaaggaaagaagatcaagctacagatatgggatacagcaggccaggagcgatttcacaccatcacaacctcctactacagaggcgcaatgggtatcatgctagtatatgacatcaccaatggtaaaagttttgaaaacatcagcaaatggcttagaaacatagatgagcatgccaatgaagatgtggaaagaatgttactaggaaacaagtgtgatatggacgacaaaagagttgtacctaaaggaaaaggagaacagattgcaagggagcatggtattaggttttttgagactagtgcaaaagcaaatataaacatcgaaaaggcgttcctcacgttagctgaagatatccttcgaaagacccctgtaaaagagcccaacagtgaaaatgtagatatcagcagtggaggaggcgtgacaggctggaagagcaaatgctgctgagcattctcctgttccatcagttgccatccactaccccgttttctcttcttgctgcaaaataaaccactctgtccatttttaactctaaacagatatttttgtttctcatcttaactatccaagccacctattttatttgttctttcatctgtgactgcttgctgactttatcataattttcttcaaacaaaaaaatgtatagaaaaatcatgtctgtgacttcatttttaaatgtacttgctcagctcaactgcatttcagttgtattatagtccagttcttatcaacattaaaacctatagcaatcatttcaaatctattctgcaaattgtataagaataaagttagaattaacaattttattttgtacaacagtggaattttctgtcatggataatgtgcttgagtccctataatctatagacatgtgatagcaaaagaaacaaacaaaagccaggaaaacactcattttcgccttgaatatgtaaatgggattaattttgtcctgtgccttatgtggaaaggaacttctttggttttccttttttgttctggtggaagcatgtgcaggagacatatcatccaaacataaaccattaaaatgtttgtggtttgcttggctgtaattttcaaagtagttaattgaggacaaagggtaatgcagaagtgatagctttggtttgctgagtcttgttttaagtggccttgatatttaaaactattcctgccaccatttcttctccttggccacttcttccttgcgtctccctgcatgctgctttatttgcttctccctccccaaccacctcatggtatatttaagagtgaaagggacaaactagtaggtttgtcaagtttaatataaagcactgatgtaacttgctaggtaaacggaaagataagttctaactgcctactatccaatgtcagttaattggtgtcttcccccctcatttgctctcttccctaaaatgtgtcccagatgccttcatttgctgttttacttctatgttctgcttttcctcctctctttgttcccttcctgtctatccattgagtttatgaaatggaagagttaactgcatgcactagtgtttggagggtgttgtggtttgtctttctaattaggtgtatagcctattcactttcctagaataaatctcttaacctaaatttgagtagtctgcattttggcaactcctctagcagcttggtagcctagtacaggttgtttttttaaaaaaggaaaagcaggaaggaggagtgaattttattaacatgtttgccaaatgtattgagatttggcctctgaagaacactttttcagtgttaagtttctttaccttaagattcagaaatactttagaatattattaattttaagtcctgtctttacatccttttggaaaacttgtattaccatgagtttggaaaaaggacaacgaaaggcttttcatgtaaagataagatctttagctatctctaaccctgtccttttttcactgcattttttctagttttgcttcattgcttatcattaggatagggtaagtgaagtttgctatgctgctagcatcctaagatgatacctttgttgaaagaattgtgaatagcatgattcatttctagcagaggctgagtttaggacagcagcttccattgagaagtctttctgtgtcgtgaatagcattttaatgacctcttggctcacataagcaaacaacatagggacgtatctgctatgaaaatccacaaatttttcagatagtgccctaaaaacaattttatatgcctcactggttgttattcttaggttattcccacacttgactttatcattgtttactactagtaaaaagcagcattgccaaataatccctaattttccactaaaaatataatgaaatgatgttaagctttttgaaaagtttaggttaaacctactgttgttagattaatgtatttgttgcttccctttatctggaatgtggcattagcttttttattttaaccctctttaattcttattcaattccatgacttaaggttggagagctaaacactgggatttttggataacagactgacagttttgcataattataatcggcattgtacatagaaaggatatggctaccttttgttaaatctgcactttctaaatatcaaaaaagggaaatgaagtataaatcaatttttgtataatctgtttgaaacatgagttttatttgcttaatattagggctttgccccttttctgtaagtctcttgggatcctgtgtagaagctgttctcattaaacaccaaacagttaagtccattctctggtactagctacaaattcggtttcatattctacttaacaatttaaataaactgaaatatttctagatggtctacttctgttcatataaaaacaaaacttgatttccagctgtgtggtttggttttcatttatttatggaattggaagattacttctgaaaaaaatgtggaatcgcaaactcaaagagttgacaaaaatgggaaatcactgtcaacctatggaaaactggaaaggcaatttcaagaactgtctttgctgagaaactacattaaaaaatagaattatctctgggatcctaaagcggaatcatccttgtgccaaaataggagatgccacgatcctaatcacacctggcttacactagttggatgtgcctaaggccactacagctgaggtcacctgattcctcagggggaccaagctgggctcctcatactggagggtaaatccttgttttagcagcagctggcctcttactaagaaacaaagtatggccaggtgcggtggctcatgcctgtaatcccagcactttgggaggtcaaggcggacggatcacgaagtcaggagatggagaccatcctggctaacgtggtaaaaccccgtctctattaaaaatacaaaaaaattagccgggcgtggtggcgggcgcctgtagtcccagctactcgggaggctgaggcaggagaatggcgtgaacccgggaggaggaggaggaggctgcagtgagccgagatagcgccactgcactccagcctgggcgacagagcaagactccgtctcaaaaaaaaaaaaaaaaaaaaaaaagtattgg

SEQ ID NO: 307116 - DNA, 3882 bp, Homo sapiens
  misc_feature (3722)..(3722): n is a, c, g, or t
cctcagactgaggcttggagacaggagcattccactcgccacttcggcgcgcccccatgccctcttgtgcgcgtgcgcagaggcggaccgcaaggctagggcgtgagggaagggcgggcgtacgcccttgcgtgcgtctcaggcagcgcgcacgccggcgtgagagggcacggggaaaaggtggctctggccggggtggctcggtttcctggggctatgtaactgagctcgtcgacttaggggtccttcttcgctgccctcgccgcgtgctagcagggagtttccgctcgggagagagactgtcctcacgcccgctgcgcctcctcgacggcagagcaggcttgctcgcccgtgggagcgtcccggccgagaagccctgaggggggaggggaggccattttgtcccgaccgactccccggaaccgggcggagcggctgggagaggctgcggagccgcggtcgccgccctcggaggcactggacgccgccactgtcggggcttcctcaaagctgttcgtaggtcgcccgcgccgtctcgagcctttttcccacgcttccccggtcctccggcctgagaacgcccgagtgaggagttggccgtagtgagagggaccgatcccttggggccgccggcggcgagagcccgagccgctcctcccaatggcgaagaagacgtacgacctgcttttcaagctgctcctgatcggggattccggagtggggaagacctgcgtcctttttcgtttttcggatgatgccttcaatactacctttatttccaccataggaatagacttcaagatcaaaacagttgaattacaaggaaagaagatcaagctacagatatgggatacagcaggccaggagcgatttcacaccatcacaacctcctactacagaggcgcaatgggtatcatgctagtatatgacatcaccaatggtaaaagttttgaaaacatcagcaaatggcttagaaacatagatgagcatgccaatgaagatgtggaaagaatgttactaggaaacaagtgtgatatggacgacaaaagagttgtacctaaaggaaaaggagaacagattgcaagggagcatggtattaggttttttgagactagtgcaaaagcaaatataaacatcgaaaaggcgttcctcacgttagctgaagatatccttcgaaagacccctgtaaaagagcccaacagtgaaaatgtagatatcagcagtggaggaggcgtgacaggctggaagagcaaatgctgctgagcattctcctgttccatcagttgccatccactaccccgttttctcttcttgctgcaaaataaaccactctgtccatttttaactctaaacagatatttttgtttctcatcttaactatccaagccacctattttatttgttctttcatctgtgactgcttgctgactttatcataattttcttcaaacaaaaaaatgtatagaaaaatcatgtctgtgacttcatttttaaatgtacttgctcagctcaactgcatttcagttgtattatagtccagttcttatcaacattaaaacctatagcaatcatttcaaatctattctgcaaattgtataagaataaagttagaattaacaattttattttgtacaacagtggaattttctgtcatggataatgtgcttgagtccctataatctatagacatgtgatagcaaaagaaacaaacaaaagccaggaaaacactcattttcgccttgaatatgtaaatgggattaattttgtcctgtgccttatgtggaaaggaacttctttggttttccttttttgttctggtggaagcatgtgcaggagacatatcatccaaacataaaccattaaaatgtttgtggtttgcttggctgtaattttcaaagtagttaattgaggacaaagggtaatgcagaagtgatagctttggtttgctgagtcttgttttaagtggccttgatatttaaaactattcctgccaccatttcttctccttggccacttcttccttgcgtctccctgcatgctgctttatttgcttctccctccccaaccacctcatggtatatttaagagtgaaagggacaaactagtaggtttgtcaagtttaatataaagcactgatgtaacttgctaggtaaacggaaagataagttctaactgcctactatccaatgtcagttaattggtgtcttcccccctcatttgctctcttccctaaaatgtgtcccagatgccttcatttgctgttttacttctatgttctgcttttcctcctctctttgttcccttcctgtctatccattgagtttatgaaatggaagagttaactgcatgcactagtgtttggagggtgttgtggtttgtctttctaattaggtgtatagcctattcactttcctagaataaatctcttaacctaaatttgagtagtctgcattttggcaactcctctagcagcttggtagcctagtacaggttgtttttttaaaaaaggaaaagcaggaaggaggagtgaattttattaacatgtttgccaaatgtattgagatttggcctctgaagaacactttttcagtgttaagtttctttaccttaagattcagaaatactttagaatattattaattttaagtcctgtctttacatccttttggaaaacttgtattaccatgagtttggaaaaaggacaacgaaaggcttttcatgtaaagataagatctttagctatctctaaccctgtccttttttcactgcattttttctagttttgcttcattgcttatcattaggatagggtaagtgaagtttgctatgctgctagcatcctaagatgatacctttgttgaaagaattgtgaatagcatgattcatttctagcagaggctgagtttaggacagcagcttccattgagaagtctttctgtgtcgtgaatagcattttaatgacctcttggctcacataagcaaacaacatagggacgtatctgctatgaaaatccacaaatttttcagatagtgccctaaaaacaattttatatgcctcactggttgttattcttaggttattcccacacttgactttatcattgtttactactagtaaaaagcagcattgccaaataatccctaattttccactaaaaatataatgaaatgatgttaagctttttgaaaagtttaggttaaacctactgttgttagattaatgtatttgttgcttccctttatctggaatgtggcattagcttttttattttaaccctctttaattcttattcaattccatgacttaaggttggagagctaaacactgggatttttggataacagactgacagttttgcataattataatcggcattgtacatagaaaggatatggctaccttttgttaaatctgcactttctaaatatcaaaaaagggaaatgaagtataaatcaatttttgtataatctgtttgaaacatgagttttatttgcttaatattagggctttgccccttttctgtaagtctcttgggatcctgtgtagaagctgttctcattaaacaccaaacagttaagtccattctctggtactagctacaaattcggtttcatattctacttaacaatttaaataaactgaaatatttctagatggtctacttctgttcatataaaaacaaaacttgatttccaaaaaaaaaaaaaaaaaaaaaccaggnatatatttaaccagaacaatcacaactttggtggaacacccgataattttgcagtggggccagtgaaccagtttgactatcaggtgaaagatattttgttgctttaatattgtaggtgttgcacgtaatcccttccttgggggtgtctcatcaagaatac

SEQ ID NO: 307117 - DNA, 3687 bp, Homo sapiens
  misc_feature (3662)..(3662): n is a, c, g, or t
cctcagactgaggcttggagacaggagcattccactcgccacttcggcgcgcccccatgccctcttgtgcgcgtgcgcagaggcggaccgcaaggctagggcgtgagggaagggcgggcgtacgcccttgcgtgcgtctcaggcagcgcgcacgccggcgtgagagggcacggggaaaaggtggctctggccggggtggctcggtttcctggggctatgtaactgagctcgtcgacttaggggtccttcttcgctgccctcgccgcgtgctagcagggagtttccgctcgggagagagactgtcctcacgcccgctgcgcctcctcgacggcagagcaggcttgctcgcccgtgggagcgtcccggccgagaagccctgaggggggaggggaggccattttgtcccgaccgactccccggaaccgggcggagcggctgggagaggctgcggagccgcggtcgccgccctcggaggcactggacgccgccactgtcggggcttcctcaaagctgttcgtaggtcgcccgcgccgtctcgagcctttttcccacgcttccccggtcctccggcctgagaacgcccgagtgaggagttggccgtagtgagagggaccgatcccttggggccgccggcggcgagagcccgagccgctcctcccaatggcgaagaagacgtacgacctgcttttcaagctgctcctgatcggggattccggagtggggaagacctgcgtcctttttcgtttttcggatgatgccttcaatactacctttatttccaccataggaatagacttcaagatcaaaacagttgaattacaaggaaagaagatcaagctacagatatgggatacagcaggccaggagcgatttcacaccatcacaacctcctactacagaggcgcaatgggtatcatgctagtatatgacatcaccaatggtaaaagttttgaaaacatcagcaaatggcttagaaacatagatgagcatgccaatgaagatgtggaaagaatgttactaggaaacaagtgtgatatggacgacaaaagagttgtacctaaaggaaaaggagaacagattgcaagggagcatggtattaggttttttgagactagtgcaaaagcaaatataaacatcgaaaaggcgttcctcacgttagctgaagatatccttcgaaagacccctgtaaaagagcccaacagtgaaaatgtagatatcagcagtggaggaggcgtgacaggctggaagagcaaatgctgctgagcattctcctgttccatcagttgccatccactaccccgttttctcttcttgctgcaaaataaaccactctgtccatttttaactctaaacagatatttttgtttctcatcttaactatccaagccacctattttatttgttctttcatctgtgactgcttgctgactttatcataattttcttcaaacaaaaaaatgtatagaaaaatcatgtctgtgacttcatttttaaatgtacttgctcagctcaactgcatttcagttgtattatagtccagttcttatcaacattaaaacctatagcaatcatttcaaatctattctgcaaattgtataagaataaagttagaattaacaattttattttgtacaacagtggaattttctgtcatggataatgtgcttgagtccctataatctatagacatgtgatagcaaaagaaacaaacaaaagccaggaaaacactcattttcgccttgaatatgtaaatgggattaattttgtcctgtgccttatgtggaaaggaacttctttggttttccttttttgttctggtggaagcatgtgcaggagacatatcatccaaacataaaccattaaaatgtttgtggtttgcttggctgtaattttcaaagtagttaattgaggacaaagggtaatgcagaagtgatagctttggtttgctgagtcttgttttaagtggccttgatatttaaaactattcctgccaccatttcttctccttggccacttcttccttgcgtctccctgcatgctgctttatttgcttctccctccccaaccacctcatggtatatttaagagtgaaagggacaaactagtaggtttgtcaagtttaatataaagcactgatgtaacttgctaggtaaacggaaagataagttctaactgcctactatccaatgtcagttaattggtgtcttcccccctcatttgctctcttccctaaaatgtgtcccagatgccttcatttgctgttttacttctatgttctgcttttcctcctctctttgttcccttcctgtctatccattgagtttatgaaatggaagagttaactgcatgcactagtgtttggagggtgttgtggtttgtctttctaattaggtgtatagcctattcactttcctagaataaatctcttaacctaaatttgagtagtctgcattttggcaactcctctagcagcttggtagcctagtacaggttgtttttttaaaaaaggaaaagcaggaaggaggagtgaattttattaacatgtttgccaaatgtattgagatttggcctctgaagaacactttttcagtgttaagtttctttaccttaagattcagaaatactttagaatattattaattttaagtcctgtctttacatccttttggaaaacttgtattaccatgagtttggaaaaaggacaacgaaaggcttttcatgtaaagataagatctttagctatctctaaccctgtccttttttcactgcattttttctagttttgcttcattgcttatcattaggatagggtaagtgaagtttgctatgctgctagcatcctaagatgatacctttgttgaaagaattgtgaatagcatgattcatttctagcagaggctgagtttaggacagcagcttccattgagaagtctttctgtgtcgtgaatagcattttaatgacctcttggctcacataagcaaacaacatagggacgtatctgctatgaaaatccacaaatttttcagatagtgccctaaaaacaattttatatgcctcactggttgttattcttaggttattcccacacttgactttatcattgtttactactagtaaaaagcagcattgccaaataatccctaattttccactaaaaatataatgaaatgatgttaagctttttgaaaagtttaggttaaacctactgttgttagattaatgtatttgttgcttccctttatctggaatgtggcattagcttttttattttaaccctctttaattcttattcaattccatgacttaaggttggagagctaaacactgggatttttggataacagactgacagttttgcataattataatcggcattgtacatagaaaggatatggctaccttttgttaaatctgcactttctaaatatcaaaaaagggaaatgaagtataaatcaatttttgtataatctgtttgaaacatgagttttatttgcttaatattagggctttgccccttttctgtaagtctcttgggatcctgtgtagaagctgttctcattaaacaccaaacagttaagtccattctctggtactagctacaaattcggtttcatattctacttaacaatttaaataaactgaaatatttctaaaaaaaaanaaaactgatagaagataatcttgtg

SEQ ID NO: 307118 - DNA, 3811 bp, Homo sapiens
cctcagactgaggcttggagacaggagcattccactcgccacttcggcgcgcccccatgccctcttgtgcgcgtgcgcagaggcggaccgcaaggctagggcgtgagggaagggcgggcgtacgcccttgcgtgcgtctcaggcagcgcgcacgccggcgtgagagggcacggggaaaaggtggctctggccggggtggctcggtttcctggggctatgtaactgagctcgtcgacttaggggtccttcttcgctgccctcgccgcgtgctagcagggagtttccgctcgggagagagactgtcctcacgcccgctgcgcctcctcgacggcagagcaggcttgctcgcccgtgggagcgtcccggccgagaagccctgaggggggaggggaggccattttgtcccgaccgactccccggaaccgggcggagcggctgggagaggctgcggagccgcggtcgccgccctcggaggcactggacgccgccactgtcggggcttcctcaaagctgttcgtaggtcgcccgcgccgtctcgagcctttttcccacgcttccccggtcctccggcctgagaacgcccgagtgaggagttggccgtagtgagagggaccgatcccttggggccgccggcggcgagagcccgagccgctcctcccaatggcgaagaagacgtacgacctgcttttcaagctgctcctgatcggggattccggagtggggaagacctgcgtcctttttcgtttttcggatgatgccttcaatactacctttatttccaccataggaatagacttcaagatcaaaacagttgaattacaaggaaagaagatcaagctacagatatgggatacagcaggccaggagcgatttcacaccatcacaacctcctactacagaggcgcaatgggtatcatgctagtatatgacatcaccaatggtaaaagttttgaaaacatcagcaaatggcttagaaacatagatgagagatggggactcgcagtgttgcccaggctggtctcaaactccaggggtcaagtgattcttccttctcagcctcccaagaagctgggattacagcctactcaatttgaagacattgaggatgaagacctttatgatgatccacttccacttaataaatacatgccaatgaagatgtggaaagaatgttactaggaaacaagtgtgatatggacgacaaaagagttgtacctaaaggaaaaggagaacagattgcaagggagcatggtattaggttttttgagactagtgcaaaagcaaatataaacatcgaaaaggcgttcctcacgttagctgaagatatccttcgaaagacccctgtaaaagagcccaacagtgaaaatgtagatatcagcagtggaggaggcgtgacaggctggaagagcaaatgctgctgagcattctcctgttccatcagttgccatccactaccccgttttctcttcttgctgcaaaataaaccactctgtccatttttaactctaaacagatatttttgtttctcatcttaactatccaagccacctattttatttgttctttcatctgtgactgcttgctgactttatcataattttcttcaaacaaaaaaatgtatagaaaaatcatgtctgtgacttcatttttaaatgtacttgctcagctcaactgcatttcagttgtattatagtccagttcttatcaacattaaaacctatagcaatcatttcaaatctattctgcaaattgtataagaataaagttagaattaacaattttattttgtacaacagtggaattttctgtcatggataatgtgcttgagtccctataatctatagacatgtgatagcaaaagaaacaaacaaaagccaggaaaacactcattttcgccttgaatatgtaaatgggattaattttgtcctgtgccttatgtggaaaggaacttctttggttttccttttttgttctggtggaagcatgtgcaggagacatatcatccaaacataaaccattaaaatgtttgtggtttgcttggctgtaattttcaaagtagttaattgaggacaaagggtaatgcagaagtgatagctttggtttgctgagtcttgttttaagtggccttgatatttaaaactattcctgccaccatttcttctccttggccacttcttccttgcgtctccctgcatgctgctttatttgcttctccctccccaaccacctcatggtatatttaagagtgaaagggacaaactagtaggtttgtcaagtttaatataaagcactgatgtaacttgctaggtaaacggaaagataagttctaactgcctactatccaatgtcagttaattggtgtcttcccccctcatttgctctcttccctaaaatgtgtcccagatgccttcatttgctgttttacttctatgttctgcttttcctcctctctttgttcccttcctgtctatccattgagtttatgaaatggaagagttaactgcatgcactagtgtttggagggtgttgtggtttgtctttctaattaggtgtatagcctattcactttcctagaataaatctcttaacctaaatttgagtagtctgcattttggcaactcctctagcagcttggtagcctagtacaggttgtttttttaaaaaaggaaaagcaggaaggaggagtgaattttattaacatgtttgccaaatgtattgagatttggcctctgaagaacactttttcagtgttaagtttctttaccttaagattcagaaatactttagaatattattaattttaagtcctgtctttacatccttttggaaaacttgtattaccatgagtttggaaaaaggacaacgaaaggcttttcatgtaaagataagatctttagctatctctaaccctgtccttttttcactgcattttttctagttttgcttcattgcttatcattaggatagggtaagtgaagtttgctatgctgctagcatcctaagatgatacctttgttgaaagaattgtgaatagcatgattcatttctagcagaggctgagtttaggacagcagcttccattgagaagtctttctgtgtcgtgaatagcattttaatgacctcttggctcacataagcaaacaacatagggacgtatctgctatgaaaatccacaaatttttcagatagtgccctaaaaacaattttatatgcctcactggttgttattcttaggttattcccacacttgactttatcattgtttactactagtaaaaagcagcattgccaaataatccctaattttccactaaaaatataatgaaatgatgttaagctttttgaaaagtttaggttaaacctactgttgttagattaatgtatttgttgcttccctttatctggaatgtggcattagcttttttattttaaccctctttaattcttattcaattccatgacttaaggttggagagctaaacactgggatttttggataacagactgacagttttgcataattataatcggcattgtacatagaaaggatatggctaccttttgttaaatctgcactttctaaatatcaaaaaagggaaatgaagtataaatcaatttttgtataatctgtttgaaacatgagttttatttgcttaatattagggctttgccccttttctgtaagtctcttgggatcctgtgtagaagctgttctcattaaacaccaaacagttaagtccattctctggtactagctacaaattcggtttcatattctacttaacaatttaaataaactgaaatatttcta

SEQ ID NO: 307119 - DNA, 3599 bp, Homo sapiens
cctcagactgaggcttggagacaggagcattccactcgccacttcggcgcgcccccatgccctcttgtgcgcgtgcgcagaggcggaccgcaaggctagggcgtgagggaagggcgggcgtacgcccttgcgtgcgtctcaggcagcgcgcacgccggcgtgagagggcacggggaaaaggtggctctggccggggtggctcggtttcctggggctatgtaactgagctcgtcgacttaggggtccttcttcgctgccctcgccgcgtgctagcagggagtttccgctcgggagagagactgtcctcacgcccgctgcgcctcctcgacggcagagcaggcttgctcgcccgtgggagcgtcccggccgagaagccctgaggggggaggggaggccattttgtcccgaccgactccccggaaccgggcggagcggctgggagaggctgcggagccgcggtcgccgccctcggaggcactggacgccgccactgtcggggcttcctcaaagctgttcgtaggtcgcccgcgccgtctcgagcctttttcccacgcttccccggtcctccggcctgagaacgcccgagtgaggagttggccgtagtgagagggaccgatcccttggggccgccggcggcgagagcccgagccgctcctcccaatggcgaagaagacgtacgacctgcttttcaagctgctcctgatcggggattccggagtggggaagacctgcgtcctttttcgtttttcggatgatgccttcaatactacctttatttccaccataggaatagacttcaagatcaaaacagttgaattacaaggaaagaagatcaagctacagatatgggatacagcaggccaggagcgatttcacaccatcacaacctcctactacagaggcgcaatgggtatcatgctagtatatgacatcaccaatggtaaaagttttgaaaacatcagcaaatggcttagaaacatagatgagcatgccaatgaagatgtggaaagaatgttactaggaaacaagtgtgatatggacgacaaaagagttgtacctaaaggaaaaggagaacagattgcaagggagcatggtattaggttttttgagactagtgcaaaagcaaatataaacatcgaaaaggcgttcctcacgttagctgaagatatccttcgaaagacccctgtaaaagagcccaacagtgaaaatgtagatatcagcagtggaggaggcgtgacaggctggaagagcaaatgctgctgagcattctcctgttccatcagttgccatccactaccccgttttctcttcttgctgcaaaataaaccactctgtccatttttaactctaaacagatatttttgtttctcatcttaactatccaagccacctattttatttgttctttcatctgtgactgcttgctgactttatcataattttcttcaaacaaaaaaatgtatagaaaaatcatgtctgtgacttcatttttaaatgtacttgctcagctcaactgcatttcagttgtattatagtccagttcttatcaacattaaaacctatagcaatcatttcaaatctattctgcaaattgtataagaataaagttagaattaacaattttattttgtacaacagtggaattttctgtcatggataatgtgcttgagtccctataatctatagacatgtgatagcaaaagaaacaaacaaaagccaggaaaacactcattttcgccttgaatatgtaaatgggattaattttgtcctgtgccttatgtggaaaggaacttctttggttttccttttttgttctggtggaagcatgtgcaggagacatatcatccaaacataaaccattaaaatgtttgtggtttgcttggctgtaattttcaaagtagttaattgaggacaaagggtaatgcagaagtgatagctttggtttgctgagtcttgttttaagtggccttgatatttaaaactattcctgccaccatttcttctccttggccacttcttccttgcgtctccctgcatgctgctttatttgcttctccctccccaaccacctcatggtatatttaagagtgaaagggacaaactagtaggtttgtcaagtttaatataaagcactgatgtaacttgctaggtaaacggaaagataagttctaactgcctactatccaatgtcagttaattggtgtcttcccccctcatttgctctcttccctaaaatgtgtcccagatgccttcatttgctgttttacttctatgttctgcttttcctcctctctttgttcccttcctgtctatccattgagtttatgaaatggaagagttaactgcatgcactagtgtttggagggtgttgtggtttgtctttctaattaggtgtatagcctattcactttcctagaataaatctcttaacctaaatttgagtagtctgcattttggcaactcctctagcagcttggtagcctagtacaggttgtttttttaaaaaaggaaaagcaggaaggaggagtgaattttattaacatgtttgccaaatgtattgagatttggcctctgaagaacactttttcagtgttaagtttctttaccttaagattcagaaatactttagaatattattaattttaagtcctgtctttacatccttttggaaaacttgtattaccatgagtttggaacctgtccttttttcactgcattttttctagttttgcttcattgcttatcattaggatagggtaagtgaagtttgctatgctgctagcatcctaagatgatacctttgttgaaagaattgtgaatagcatgattcatttctagcagaggctgagtttaggacagcagcttccattgagaagtctttctgtgtcgtgaatagcattttaatgacctcttggctcacataagcaaacaacatagggacgtatctgctatgaaaatccacaaatttttcagatagtgccctaaaaacaattttatatgcctcactggttgttattcttaggttattcccacacttgactttatcattgtttactactagtaaaaagcagcattgccaaataatccctaattttccactaaaaatataatgaaatgatgttaagctttttgaaaagtttaggttaaacctactgttgttagattaatgtatttgttgcttccctttatctggaatgtggcattagcttttttattttaaccctctttaattcttattcaattccatgacttaaggttggagagctaaacactgggatttttggataacagactgacagttttgcataattataatcggcattgtacatagaaaggatatggctaccttttgttaaatctgcactttctaaatatcaaaaaagggaaatgaagtataaatcaatttttgtataatctgtttgaaacatgagttttatttgcttaatattagggctttgccccttttctgtaagtctcttgggatcctgtgtagaagctgttctcattaaacaccaaacagttaagtccattctctggtactagctacaaattcggtttcatattctacttaacaatttaaataaactgaaatatttcta

SEQ ID NO: 307120 - DNA, 3599 bp, Homo sapiens
cctcagactgaggcttggagacaggagcattccactcgccacttcggcgcgcccccatgccctcttgtgcgcgtgcgcagaggcggaccgcaaggctagggcgtgagggaagggcgggcgtacgcccttgcgtgcgtctcaggcagcgcgcacgccggcgtgagagggcacggggaaaaggtggctctggccggggtggctcggtttcctggggctatgtaactgagctcgtcgacttaggggtccttcttcgctgccctcgccgcgtgctagcagggagtttccgctcgggagagagactgtcctcacgcccgctgcgcctcctcgacggcagagcaggcttgctcgcccgtgggagcgtcccggccgagaagccctgaggggggaggggaggccattttgtcccgaccgactccccggaaccgggcggagcggctgggagaggctgcggagccgcggtcgccgccctcggaggcactggacgccgccactgtcggggcttcctcaaagctgttcgtaggtcgcccgcgccgtctcgagcctttttcccacgcttccccggtcctccggcctgagaacgcccgagtgaggagttggccgtagtgagagggaccgatcccttggggccgccggcggcgagagcccgagccgctcctcccaatggcgaagaagacgtacgacctgcttttcaagctgctcctgatcggggattccggagtggggaagacctgcgtcctttttcgtttttcggatgatgccttcaatactacctttatttccaccataggaatagacttcaagatcaaaacagttgaattacaaggaaagaagatcaagctacagatatgggatacagcaggccaggagcgatttcacaccatcacaacctcctactacagaggcgcaatgggtatcatgctagtatatgacatcaccaatggtaaaagttttgaaaaaatgttactaggaaacaagtgtgatatggacgacaaaagagttgtacctaaaggaaaaggagaacagattgcaagggagcatggtattaggttttttgagactagtgcaaaagcaaatataaacatcgaaaaggcgttcctcacgttagctgaagatatccttcgaaagacccctgtaaaagagcccaacagtgaaaatgtagatatcagcagtggaggaggcgtgacaggctggaagagcaaatgctgctgagcattctcctgttccatcagttgccatccactaccccgttttctcttcttgctgcaaaataaaccactctgtccatttttaactctaaacagatatttttgtttctcatcttaactatccaagccacctattttatttgttctttcatctgtgactgcttgctgactttatcataattttcttcaaacaaaaaaatgtatagaaaaatcatgtctgtgacttcatttttaaatgtacttgctcagctcaactgcatttcagttgtattatagtccagttcttatcaacattaaaacctatagcaatcatttcaaatctattctgcaaattgtataagaataaagttagaattaacaattttattttgtacaacagtggaattttctgtcatggataatgtgcttgagtccctataatctatagacatgtgatagcaaaagaaacaaacaaaagccaggaaaacactcattttcgccttgaatatgtaaatgggattaattttgtcctgtgccttatgtggaaaggaacttctttggttttccttttttgttctggtggaagcatgtgcaggagacatatcatccaaacataaaccattaaaatgtttgtggtttgcttggctgtaattttcaaagtagttaattgaggacaaagggtaatgcagaagtgatagctttggtttgctgagtcttgttttaagtggccttgatatttaaaactattcctgccaccatttcttctccttggccacttcttccttgcgtctccctgcatgctgctttatttgcttctccctccccaaccacctcatggtatatttaagagtgaaagggacaaactagtaggtttgtcaagtttaatataaagcactgatgtaacttgctaggtaaacggaaagataagttctaactgcctactatccaatgtcagttaattggtgtcttcccccctcatttgctctcttccctaaaatgtgtcccagatgccttcatttgctgttttacttctatgttctgcttttcctcctctctttgttcccttcctgtctatccattgagtttatgaaatggaagagttaactgcatgcactagtgtttggagggtgttgtggtttgtctttctaattaggtgtatagcctattcactttcctagaataaatctcttaacctaaatttgagtagtctgcattttggcaactcctctagcagcttggtagcctagtacaggttgtttttttaaaaaaggaaaagcaggaaggaggagtgaattttattaacatgtttgccaaatgtattgagatttggcctctgaagaacactttttcagtgttaagtttctttaccttaagattcagaaatactttagaatattattaattttaagtcctgtctttacatccttttggaaaacttgtattaccatgagtttggaaaaaggacaacgaaaggcttttcatgtaaagataagatctttagctatctctaaccctgtccttttttcactgcattttttctagttttgcttcattgcttatcattaggatagggtaagtgaagtttgctatgctgctagcatcctaagatgatacctttgttgaaagaattgtgaatagcatgattcatttctagcagaggctgagtttaggacagcagcttccattgagaagtctttctgtgtcgtgaatagcattttaatgacctcttggctcacataagcaaacaacatagggacgtatctgctatgaaaatccacaaatttttcagatagtgccctaaaaacaattttatatgcctcactggttgttattcttaggttattcccacacttgactttatcattgtttactactagtaaaaagcagcattgccaaataatccctaattttccactaaaaatataatgaaatgatgttaagctttttgaaaagtttaggttaaacctactgttgttagattaatgtatttgttgcttccctttatctggaatgtggcattagcttttttattttaaccctctttaattcttattcaattccatgacttaaggttggagagctaaacactgggatttttggataacagactgacagttttgcataattataatcggcattgtacatagaaaggatatggctaccttttgttaaatctgcactttctaaatatcaaaaaagggaaatgaagtataaatcaatttttgtataatctgtttgaaacatgagttttatttgcttaatattagggctttgccccttttctgtaagtctcttgggatcctgtgtagaagctgttctcattaaacaccaaacagttaagtccattctctggtactagctacaaattcggtttcatattctacttaacaatttaaataaactgaaatatttcta

SEQ ID NO: 307121 - DNA, 3592 bp, Homo sapiens
cctcagactgaggcttggagacaggagcattccactcgccacttcggcgcgcccccatgccctcttgtgcgcgtgcgcagaggcggaccgcaaggctagggcgtgagggaagggcgggcgtacgcccttgcgtgcgtctcaggcagcgcgcacgccggcgtgagagggcacggggaaaaggtggctctggccggggtggctcggtttcctggggctatgtaactgagctcgtcgacttaggggtccttcttcgctgccctcgccgcgtgctagcagggagtttccgctcgggagagagactgtcctcacgcccgctgcgcctcctcgacggcagagcaggcttgctcgcccgtgggagcgtcccggccgagaagccctgaggggggaggggaggccattttgtcccgaccgactccccggaaccgggcggagcggctgggagaggctgcggagccgcggtcgccgccctcggaggcactggacgccgccactgtcggggcttcctcaaagctgttcgtaggtcgcccgcgccgtctcgagcctttttcccacgcttccccggtcctccggcctgagaacgcccgagtgaggagttggccgtagtgagagggaccgatcccttggggccgccggcggcgagagcccgagccgctcctcccaatggcgaagaagacgtacgacctgcttttcaagctgctcctgatcggggattccggagtggggaagacctgcgtcctttttcgtttttcggatgatgccttcaatactacctttatttccaccatagggatacagcaggccaggagcgatttcacaccatcacaacctcctactacagaggcgcaatgggtatcatgctagtatatgacatcaccaatggtaaaagttttgaaaacatcagcaaatggcttagaaacatagatgagcatgccaatgaagatgtggaaagaatgttactaggaaacaagtgtgatatggacgacaaaagagttgtacctaaaggaaaaggagaacagattgcaagggagcatggtattaggttttttgagactagtgcaaaagcaaatataaacatcgaaaaggcgttcctcacgttagctgaagatatccttcgaaagacccctgtaaaagagcccaacagtgaaaatgtagatatcagcagtggaggaggcgtgacaggctggaagagcaaatgctgctgagcattctcctgttccatcagttgccatccactaccccgttttctcttcttgctgcaaaataaaccactctgtccatttttaactctaaacagatatttttgtttctcatcttaactatccaagccacctattttatttgttctttcatctgtgactgcttgctgactttatcataattttcttcaaacaaaaaaatgtatagaaaaatcatgtctgtgacttcatttttaaatgtacttgctcagctcaactgcatttcagttgtattatagtccagttcttatcaacattaaaacctatagcaatcatttcaaatctattctgcaaattgtataagaataaagttagaattaacaattttattttgtacaacagtggaattttctgtcatggataatgtgcttgagtccctataatctatagacatgtgatagcaaaagaaacaaacaaaagccaggaaaacactcattttcgccttgaatatgtaaatgggattaattttgtcctgtgccttatgtggaaaggaacttctttggttttccttttttgttctggtggaagcatgtgcaggagacatatcatccaaacataaaccattaaaatgtttgtggtttgcttggctgtaattttcaaagtagttaattgaggacaaagggtaatgcagaagtgatagctttggtttgctgagtcttgttttaagtggccttgatatttaaaactattcctgccaccatttcttctccttggccacttcttccttgcgtctccctgcatgctgctttatttgcttctccctccccaaccacctcatggtatatttaagagtgaaagggacaaactagtaggtttgtcaagtttaatataaagcactgatgtaacttgctaggtaaacggaaagataagttctaactgcctactatccaatgtcagttaattggtgtcttcccccctcatttgctctcttccctaaaatgtgtcccagatgccttcatttgctgttttacttctatgttctgcttttcctcctctctttgttcccttcctgtctatccattgagtttatgaaatggaagagttaactgcatgcactagtgtttggagggtgttgtggtttgtctttctaattaggtgtatagcctattcactttcctagaataaatctcttaacctaaatttgagtagtctgcattttggcaactcctctagcagcttggtagcctagtacaggttgtttttttaaaaaaggaaaagcaggaaggaggagtgaattttattaacatgtttgccaaatgtattgagatttggcctctgaagaacactttttcagtgttaagtttctttaccttaagattcagaaatactttagaatattattaattttaagtcctgtctttacatccttttggaaaacttgtattaccatgagtttggaaaaaggacaacgaaaggcttttcatgtaaagataagatctttagctatctctaaccctgtccttttttcactgcattttttctagttttgcttcattgcttatcattaggatagggtaagtgaagtttgctatgctgctagcatcctaagatgatacctttgttgaaagaattgtgaatagcatgattcatttctagcagaggctgagtttaggacagcagcttccattgagaagtctttctgtgtcgtgaatagcattttaatgacctcttggctcacataagcaaacaacatagggacgtatctgctatgaaaatccacaaatttttcagatagtgccctaaaaacaattttatatgcctcactggttgttattcttaggttattcccacacttgactttatcattgtttactactagtaaaaagcagcattgccaaataatccctaattttccactaaaaatataatgaaatgatgttaagctttttgaaaagtttaggttaaacctactgttgttagattaatgtatttgttgcttccctttatctggaatgtggcattagcttttttattttaaccctctttaattcttattcaattccatgacttaaggttggagagctaaacactgggatttttggataacagactgacagttttgcataattataatcggcattgtacatagaaaggatatggctaccttttgttaaatctgcactttctaaatatcaaaaaagggaaatgaagtataaatcaatttttgtataatctgtttgaaacatgagttttatttgcttaatattagggctttgccccttttctgtaagtctcttgggatcctgtgtagaagctgttctcattaaacaccaaacagttaagtccattctctggtactagctacaaattcggtttcatattctacttaacaatttaaataaactgaaatatttcta

SEQ ID NO: 307122 - DNA, 3061 bp, Homo sapiens
gaacccctgacctcatgtgatccacccacctcagcctcccaaagtgctggctttacaggcgtgagccaccacatgcggtataatttttctttgttaagcttgtgattctactaagggtatcgtccttgcaacaaaagagttgtttcctccctaatcccacctttgtctacccccttttaaactgtcattgacccttgaactgcaggttcacttacacatggatatttttgtttaaagagatggggactcgcagtgttgcccaggctggtctcaaactccaggggtcaagtgattcttccttctcagcctcccaagaagctgggattacagcctactcaatttgaagacattgaggatgaagacctttatgatgatccacttccacttaataaatacatgccaatgaagatgtggaaagaatgttactaggaaacaagtgtgatatggacgacaaaagagttgtacctaaaggaaaaggagaacagattgcaagggagcatggtattaggttttttgagactagtgcaaaagcaaatataaacatcgaaaaggcgttcctcacgttagctgaagatatccttcgaaagacccctgtaaaagagcccaacagtgaaaatgtagatatcagcagtggaggaggcgtgacaggctggaagagcaaatgctgctgagcattctcctgttccatcagttgccatccactaccccgttttctcttcttgctgcaaaataaaccactctgtccatttttaactctaaacagatatttttgtttctcatcttaactatccaagccacctattttatttgttctttcatctgtgactgcttgctgactttatcataattttcttcaaacaaaaaaatgtatagaaaaatcatgtctgtgacttcatttttaaatgtacttgctcagctcaactgcatttcagttgtattatagtccagttcttatcaacattaaaacctatagcaatcatttcaaatctattctgcaaattgtataagaataaagttagaattaacaattttattttgtacaacagtggaattttctgtcatggataatgtgcttgagtccctataatctatagacatgtgatagcaaaagaaacaaacaaaagccaggaaaacactcattttcgccttgaatatgtaaatgggattaattttgtcctgtgccttatgtggaaaggaacttctttggttttccttttttgttctggtggaagcatgtgcaggagacatatcatccaaacataaaccattaaaatgtttgtggtttgcttggctgtaattttcaaagtagttaattgaggacaaagggtaatgcagaagtgatagctttggtttgctgagtcttgttttaagtggccttgatatttaaaactattcctgccaccatttcttctccttggccacttcttccttgcgtctccctgcatgctgctttatttgcttctccctccccaaccacctcatggtatatttaagagtgaaagggacaaactagtaggtttgtcaagtttaatataaagcactgatgtaacttgctaggtaaacggaaagataagttctaactgcctactatccaatgtcagttaattggtgtcttcccccctcatttgctctcttccctaaaatgtgtcccagatgccttcatttgctgttttacttctatgttctgcttttcctcctctctttgttcccttcctgtctatccattgagtttatgaaatggaagagttaactgcatgcactagtgtttggagggtgttgtggtttgtctttctaattaggtgtatagcctattcactttcctagaataaatctcttaacctaaatttgagtagtctgcattttggcaactcctctagcagcttggtagcctagtacaggttgtttttttaaaaaaggaaaagcaggaaggaggagtgaattttattaacatgtttgccaaatgtattgagatttggcctctgaagaacactttttcagtgttaagtttctttaccttaagattcagaaatactttagaatattattaattttaagtcctgtctttacatccttttggaaaacttgtattaccatgagtttggaaaaaggacaacgaaaggcttttcatgtaaagataagatctttagctatctctaaccctgtccttttttcactgcattttttctagttttgcttcattgcttatcattaggatagggtaagtgaagtttgctatgctgctagcatcctaagatgatacctttgttgaaagaattgtgaatagcatgattcatttctagcagaggctgagtttaggacagcagcttccattgagaagtctttctgtgtcgtgaatagcattttaatgacctcttggctcacataagcaaacaacatagggacgtatctgctatgaaaatccacaaatttttcagatagtgccctaaaaacaattttatatgcctcactggttgttattcttaggttattcccacacttgactttatcattgtttactactagtaaaaagcagcattgccaaataatccctaattttccactaaaaatataatgaaatgatgttaagctttttgaaaagtttaggttaaacctactgttgttagattaatgtatttgttgcttccctttatctggaatgtggcattagcttttttattttaaccctctttaattcttattcaattccatgacttaaggttggagagctaaacactgggatttttggataacagactgacagttttgcataattataatcggcattgtacatagaaaggatatggctaccttttgttaaatctgcactttctaaatatcaaaaaagggaaatgaagtataaatcaatttttgtataatctgtttgaaacatgagttttatttgcttaatattagggctttgccccttttctgtaagtctcttgggatcctgtgtagaagctgttctcattaaacaccaaacagttaagtccattctctggtactagctacaaattcggtttcatattctacttaacaatttaaataaactgaaatatttcta

SEQ ID NO: 307123 - DNA, 2359 bp, Homo sapiens
cctcagactgaggcttggagacaggagcattccactcgccacttcggcgcgcccccatgccctcttgtgcgcgtgcgcagaggcggaccgcaaggctagggcgtgagggaagggcgggcgtacgcccttgcgtgcgtctcaggcagcgcgcacgccggcgtgagagggcacggggaaaaggtggctctggccggggtggctcggtttcctggggctatgtaactgagctcgtcgacttaggggtccttcttcgctgccctcgccgcgtgctagcagggagtttccgctcgggagagagactgtcctcacgcccgctgcgcctcctcgacggcagagcaggcttgctcgcccgtgggagcgtcccggccgagaagccctgaggggggaggggaggccattttgtcccgaccgactccccggaaccgggcggagcggctgggagaggctgcggagccgcggtcgccgccctcggaggcactggacgccgccactgtcggggcttcctcaaagctgttcgtaggtcgcccgcgccgtctcgagcctttttcccacgcttccccggtcctccggcctgagaacgcccgagtgaggagttggccgtagtgagagggaccgatcccttggggccgccggcggcgagagcccgagccgctcctcccaatggcgaagaagacgtacgacctgcttttcaagctgctcctgatcggggattccggagtggggaagacctgcgtcctttttcgtttttcggatgatgccttcaatactacctttatttccaccataggaatagacttcaagatcaaaacagttgaattacaaggaaagaagatcaagctacagatatgggatacagcaggccaggagcgatttcacaccatcacaacctcctactacagaggcgcaatgggtatcatgctagtatatgacatcaccaatggtaaaagttttgaaaacatcagcaaatggcttagaaacatagatgagcatgccaatgaagatgtggaaagaatgttactaggaaacaagtgtgatatggacgacaaaagagttgtacctaaaggaaaaggagaacagattgcaagggagcatggtattaggttttttgagactagtgcaaaagcaaatataaacatcgaaaaggcgttcctcacgttagctgaagatatccttcgaaagacccctgtaaaagagcccaacagtgaaaatgtagatatcagcagtggaggaggcgtgacaggctggaagagcaaatgctgctgagcattctcctgttccatcagttgccatccactaccccgttttctcttcttgctgcaaaataaaccactctgtccatttttaactctaaacagatatttttgtttctcatcttaactatccaagccacctattttatttgttctttcatctgtgactgcttgctgactttatcataattttcttcaaacaaaaaaatgtatagaaaaatcatgtctgtgacttcatttttaaatgtacttgctcagctcaactgcatttcagttgtattatagtccagttcttatcaacattaaaacctatagcaatcatttcaaatctattctgcaaattgtataagaataaagttagaattaacaattttattttgtacaacagtggaattttctgtcatggataatgtgcttgagtccctataatctatagacatgtgatagcaaaagaaacaaacaaaagccaggaaaacactcattttcgccttgaatatgtaaatgggattaattttgtcctgtgccttatgtggaaaggaacttctttggttttccttttttgttctggtggaagcatgtgcaggagacatatcatccaaacataaaccattaaaatgtttgtggtttgcttggctgtaattttcaaagtagttaattgaggacaaagggtaatgcagaagtgatagctttggtttgctgagtcttgttttaagtggccttgatatttaaaactattcctgccaccatttcttctccttggccacttcttccttgcgtctccctgcatgctgctttatttgcttctccctccccaaccacctcatggtatatttaagagtgaaagggacaaactagtaggtttgtcaagtttaatataaagcactgatgtaacttgctaggtaaacggaaagataagttctaactgcctactatccaatgtcagttaattggtgtcttcccccctcatttgctctcttccctaaaatgtgtcccagatgccttcatttgctgttttacttctatgttctgcttttcctcctctctttgttcccttcctgggcatcctttggggttagaaaaagggaagaaataactccctccccctaagt

SEQ ID NO: 307124 - DNA, 2270 bp, Homo sapiens
  misc_feature (2099)..(2099): n is a, c, g, or t
  misc_feature (2207)..(2207): n is a, c, g, or t
  misc_feature (2243)..(2243): n is a, c, g, or t
cctcagactgaggcttggagacaggagcattccactcgccacttcggcgcgcccccatgccctcttgtgcgcgtgcgcagaggcggaccgcaaggctagggcgtgagggaagggcgggcgtacgcccttgcgtgcgtctcaggcagcgcgcacgccggcgtgagagggcacggggaaaaggtggctctggccggggtggctcggtttcctggggctatgtaactgagctcgtcgacttaggggtccttcttcgctgccctcgccgcgtgctagcagggagtttccgctcgggagagagactgtcctcacgcccgctgcgcctcctcgacggcagagcaggcttgctcgcccgtgggagcgtcccggccgagaagccctgaggggggaggggaggccattttgtcccgaccgactccccggaaccgggcggagcggctgggagaggctgcggagccgcggtcgccgccctcggaggcactggacgccgccactgtcggggcttcctcaaagctgttcgtaggtcgcccgcgccgtctcgagcctttttcccacgcttccccggtcctccggcctgagaacgcccgagtgaggagttggccgtagtgagagggaccgatcccttggggccgccggcggcgagagcccgagccgctcctcccaatggcgaagaagacgtacgacctgcttttcaagctgctcctgatcggggattccggagtggggaagacctgcgtcctttttcgtttttcggatgatgccttcaatactacctttatttccaccataggaatagacttcaagatcaaaacagttgaattacaaggaaagaagatcaagctacagatatgggatacagcaggccaggagcgatttcacaccatcacaacctcctactacagaggcgcaatgggtatcatgctagtatatgacatcaccaatggtaaaagttttgaaaacatcagcaaatggcttagaaacatagatgagcatgccaatgaagatgtggaaagaatgttactaggaaacaagtgtgatatggacgacaaaagagttgtacctaaaggaaaaggagaacagattgcaagggagcatggtattaggttttttgagactagtgcaaaagcaaatataaacatcgaaaaggcgttcctcacgttagctgaagatatccttcgaaagacccctgtaaaagagcccaacagtgaaaatgtagatatcagcagtggaggaggcgtgacaggctggaagagcaaatgctgctgagcattctcctgttccatcagttgccatccactaccccgttttctcttcttgctgcaaaataaaccactctgtccatttttaactctaaacagatatttttgtttctcatcttaactatccaagccacctattttatttgttctttcatctgtgactgcttgctgactttatcataattttcttcaaacaaaaaaatgtatagaaaaatcatgtctgtgacttcatttttaaatgtacttgctcagctcaactgcatttcagttgtattatagtccagttcttatcaacattaaaacctatagcaatcatttcaaatctattctgcaaattgtataagaataaagttagaattaacaattttattttgtacaacagtggaattttctgtcatggataatgtgcttgagtccctataatctatagacatgtgatagcaaaagaaacaaacaaaagccaggaaaacactcattttcgccttgaatatgtaaatgggattaattttgtcctgtgccttatgtggaaaggaacttctttggttttccttttttgttctggtggaagcatgtgcaggagacatatcatccaaacataaaccattaaaatgtttgtggtttgcttggctgtaattttcaaagtagttaattgaggacaaagggtaatgcagaagtgatagctttggtttgctgagtcttgttttaagtggccttgatatttaaaactattcctgccaccatttcttcacatttgtttttcctttttttttcagctggcttttttttttacttttttattttttaatttttttttaagtattaatggatgatcctggggtgtcnctcggagagggggattgggcagggtcataggacaatagtggagggaaggtcagcagatgaacaagtgaacaagggtctcgggttttcctaggcagaggacccgggggncttccgcagggttggtgtcccgggatactggagatnagggaggggtgatgactcttaagaagc

SEQ ID NO: 307125 - DNA, 1570 bp, Homo sapiens
cctcagactgaggcttggagacaggagcattccactcgccacttcggcgcgcccccatgccctcttgtgcgcgtgcgcagaggcggaccgcaaggctagggcgtgagggaagggcgggcgtacgcccttgcgtgcgtctcaggcagcgcgcacgccggcgtgagagggcacggggaaaaggtggctctggccggggtggctcggtttcctggggctatgtaactgagctcgtcgacttaggggtccttcttcgctgccctcgccgcgtgctagcagggagtttccgctcgggagagagactgtcctcacgcccgctgcgcctcctcgacggcagagcaggcttgctcgcccgtgggagcgtcccggccgagaagccctgaggggggaggggaggccattttgtcccgaccgactccccggaaccgggcggagcggctgggagaggctgcggagccgcggtcgccgccctcggaggcactggacgccgccactgtcggggcttcctcaaagctgttcgtaggtcgcccgcgccgtctcgagcctttttcccacgcttccccggtcctccggcctgagaacgcccgagtgaggagttggccgtagtgagagggaccgatcccttggggccgccggcggcgagagcccgagccgctcctcccaatggcgaagaagacgtacgacctgcttttcaagctgctcctgatcggggattccggagtggggaagacctgcgtcctttttcgtttttcggatgatgccttcaatactacctttatttccaccataggaatagacttcaagatcaaaacagttgaattacaaggaaagaagatcaagctacagatatgggatacagcaggccaggagcgatttcacaccatcacaacctcctactacagaggcgcaatgggtatcatgctagtatatgacatcaccaatggtaaaagttttgaaaacatcagcaaatggcttagaaacatagatgagcatgccaatgaagatgtggaaagaatgttactaggaaacaagtgtgatatggacgacaaaagagttgtacctaaaggaaaaggagaacagattgcaagggagcatggtattaggttttttgagactagtgcaaaagcaaatataaacatcgaaaaggcgttcctcacgttagctgaagatatccttcgaaagacccctgtaaaagagcccaacagtgaaaatgtagatatcagcagtggaggaggcgtgacaggctggaagagcaaatgctgctgagcattctcctgttccatcagttgccatccactaccccgttttctcttcttgctgcaaaataaaccactctgtccatttttaactctaaacagatatttttgtttctcatcttaactatccaagccacctattttatttgttctttcatctgtgactgcttgctgactttatcataattttcttcaaacaaaaaaatgtatagaaaaatcatgtctgtgacttcatttttaaatgtacttgctcagctcaactgcatttcagttgtattatagtccagttcttatcaacattaaaacctatagcaatc

SEQ ID NO: 307126 - DNA, 1619 bp, Homo sapiens
cctcagactgaggcttggagacaggagcattccactcgccacttcggcgcgcccccatgccctcttgtgcgcgtgcgcagaggcggaccgcaaggctagggcgtgagggaagggcgggcgtacgcccttgcgtgcgtctcaggcagcgcgcacgccggcgtgagagggcacggggaaaaggtggctctggccggggtggctcggtttcctggggctatgtaactgagctcgtcgacttaggggtccttcttcgctgccctcgccgcgtgctagcagggagtttccgctcgggagagagactgtcctcacgcccgctgcgcctcctcgacggcagagcaggcttgctcgcccgtgggagcgtcccggccgagaagccctgaggggggaggggaggccattttgtcccgaccgactccccggaaccgggcggagcggctgggagaggctgcggagccgcggtcgccgccctcggaggcactggacgccgccactgtcggggcttcctcaaagctgttcgtaggtcgcccgcgccgtctcgagcctttttcccacgcttccccggtcctccggcctgagaacgcccgagtgaggagttggccgtagtgagagggaccgatcccttggggccgccggcggcgagagcccgagccgctcctcccaatggcgaagaagacgtacgacctgcttttcaagctgctcctgatcggggattccggagtggggaagacctgcgtcctttttcgtttttcggatgatgccttcaatactacctttatttccaccataggaatagacttcaagatcaaaacagttgaattacaaggaaagaagatcaagctacagatatgggatacagcaggccaggagcgatttcacaccatcacaacctcctactacagaggcgcaatgggtatcatgctagtatatgacatcaccaatggtaaaagttttgaaaacatcagcaaatggcttagaaacatagatgagcatgccaatgaagatgtggaaagaatgttactaggaaacaagtgtgatatggacgacaaaagagttgtacctaaaggaaaaggagaacagattgcaagggagcatggtattaggttttttgagactagtgcaaaagcaaatataaacatcgaaaaggcgttcctcacgttagctgaagatatccttcgaaagacccctgtaaaagagcccaacagtgaaaatgtagatatcagcagtggaggaggcgtgacaggctggaagagcaaatgctgctgagcattctcctgttccatcagttgccatccactaccccgttttctcttcttgctgcaaaataaaccactctgtccatttttaactctaaacagatatttttgtttctcatcttaactatccaagccacctattttatttgttctttcatctgtgactgcttgctgactttatcataattttcttcaaacaaaaaaatgtatagaaaaatcatgtctgtgacttcatttttaaatgtacttgctcagctcaactgcatttcagttgtattatagtccagttcttatcaacattaaaacctatagcaatcatttcaaatctattctgcaaattgtataagaataaagttagaattaaca

SEQ ID NO: 307127 - DNA, 1819 bp, Homo sapiens
cctcagactgaggcttggagacaggagcattccactcgccacttcggcgcgcccccatgccctcttgtgcgcgtgcgcagaggcggaccgcaaggctagggcgtgagggaagggcgggcgtacgcccttgcgtgcgtctcaggcagcgcgcacgccggcgtgagagggcacggggaaaaggtggctctggccggggtggctcggtttcctggggctatgtaactgagctcgtcgacttaggggtccttcttcgctgccctcgccgcgtgctagcagggagtttccgctcgggagagagactgtcctcacgcccgctgcgcctcctcgacggcagagcaggcttgctcgcccgtgggagcgtcccggccgagaagccctgaggggggaggggaggccattttgtcccgaccgactccccggaaccgggcggagcggctgggagaggctgcggagccgcggtcgccgccctcggaggcactggacgccgccactgtcggggcttcctcaaagctgttcgtaggtcgcccgcgccgtctcgagcctttttcccacgcttccccggtcctccggcctgagaacgcccgagtgaggagttggccgtagtgagagggaccgatcccttggggccgccggcggcgagagcccgagccgctcctcccaatggcgaagaagacgtacgacctgcttttcaagctgctcctgatcggggattccggagtggggaagacctgcgtcctttttcgtttttcggatgatgccttcaatactacctttatttccaccataggaatagacttcaagatcaaaacagttgaattacaaggaaagaagatcaagctacagatatgggatacagcaggccaggagcgatttcacaccatcacaacctcctactacagaggcgcaatgggtatcatgctagtatatgacatcaccaatggtaaaagttttgaaaacatcagcaaatggcttagaaacatagatgagagatggggactcgcagtgttgcccaggctggtctcaaactccaggggtcaagtgattcttccttctcagcctcccaagaagctgggattacaggtgtgtgccaccacacccagctctataaacaggtttttaaaaacaaatcttttggaaaaaatgttagagacttgcaacaatttgaaaaactcacagacaagccacataacctagaaatattgggcgggggggaaattaagaaaaagttaagtatattatgaatgtctaaagtatatgtagatactagtctattttattactaccataaaacatacacagatctattattaaaagtttaaatttattaacactcaaacacacagagcccatacaaggcaccttttgcatcaagagaaatgtaacagagatgcagtattaaatcataattgcataaaaataactaatacatactgtactactgtgataattttgtagccacctcctgttgctattttggtgagctcgtatgtttccaagtgtctgcttaaaacaccatgtgatgtggatcatctccccgtgaacagtttgtgtctccagtaaatcccatattgcaatcaagaaaaaaaaaccgtaaaaaatttcctatccataatttgtctatgaccaccaatttataaatgcttataatgtaaacacccactttttaatgaataaatatccgtaaactagcctgtactttatccgtgtagagctattgaatgtttgggcaggtttatctatatcctacggtggcatttctctgttagtggtccaacctttttatatgagttgttttttttattgtaccctgtgttacccc

SEQ ID NO: 307128 - DNA, 1049 bp, Homo sapiens
cctcagactgaggcttggagacaggagcattccactcgccacttcggcgcgcccccatgccctcttgtgcgcgtgcgcagaggcggaccgcaaggctagggcgtgagggaagggcgggcgtacgcccttgcgtgcgtctcaggcagcgcgcacgccggcgtgagagggcacggggaaaaggtggctctggccggggtggctcggtttcctggggctatgtaactgagctcgtcgacttaggggtccttcttcgctgccctcgccgcgtgctagcagggagtttccgctcgggagagagactgtcctcacgcccgctgcgcctcctcgacggcagagcaggcttgctcgcccgtgggagcgtcccggccgagaagccctgaggggggaggggaggccattttgtcccgaccgactccccggaaccgggcggagcggctgggagaggctgcggagccgcggtcgccgccctcggaggcactggacgccgccactgtcggggcttcctcaaagctgttcgtaggtcgcccgcgccgtctcgagcctttttcccacgcttccccggtcctccggcctgagaacgcccgagtgaggagttggccgtagtgagagggaccgatcccttggggccgccggcggcgagagcccgagccgctcctcccaatggcgaagaagacgtacgacctgcttttcaagctgctcctgatcggggattccggagtggggaagacctgcgtcctttttcgtttttcggatgatgccttcaatactacctttatttccaccataggagcaaaactgaatctcgaaagataaatgaagtttaccaggaaaagaaaactgggatgaggagaggatttacgaagtagcatatgctaaacgagagacatgagaaaacatgatgatcagggatgtcatgtagactgaagactttgatactaagaggcattttcacaattttatcctgaaagcatagagaaaacaaatcaacttgtcattttcaaaaacttaccctggctgtaatctcaataaaaggacatcttttaaagtca

SEQ ID NO: 307129 - DNA, 1123 bp, Homo sapiens
cctcagactgaggcttggagacaggagcattccactcgccacttcggcgcgcccccatgccctcttgtgcgcgtgcgcagaggcggaccgcaaggctagggcgtgagggaagggcgggcgtacgcccttgcgtgcgtctcaggcagcgcgcacgccggcgtgagagggcacggggaaaaggtggctctggccggggtggctcggtttcctggggctatgtaactgagctcgtcgacttaggggtccttcttcgctgccctcgccgcgtgctagcagggagtttccgctcgggagagagactgtcctcacgcccgctgcgcctcctcgacggcagagcaggcttgctcgcccgtgggagcgtcccggccgagaagccctgaggggggaggggaggccattttgtcccgaccgactccccggaaccgggcggagcggctgggagaggctgcggagccgcggtcgccgccctcggaggcactggacgccgccactgtcggggcttcctcaaagctgttcgtaggtcgcccgcgccgtctcgagcctttttcccacgcttccccggtcctccggcctgagaacgcccgagtgaggagttggccgtagtgagagggaccgatcccttggggccgccggcggcgagagcccgagccgctcctcccaatggcgaagaagacgtacgacctgcttttcaagctgctcctgatcggggattccggagtggggaagacctgcgtcctttttcgtttttcggatgatgccttcaatactacctttatttccaccataggagcaaaactgaatctcgaaagataaatgaagtttaccaggaaaagaaaactgggatgaggagaggatttacgaagtagcatatgctaaacgagagacatgagaaaacatgatgatcagggatgtcatgtagactgaagactttgatactaagaggcattttcacaattttatcctgaaagcatagagaaaacaaatcaacttgtcattttcaaaaacttaccctggctgtaatctcaataaaaggacatcttttaaagtcaagctttatgaaaaatttactaccttgtttttgtttttctcatgttttttatttattttgaggagtggggtgtta

SEQ ID NO: 307130 - DNA, 1092 bp, Homo sapiens
  misc_feature (726)..(726): n is a, c, g, or t
  misc_feature (730)..(730): n is a, c, g, or t
cctcagactgaggcttggagacaggagcattccactcgccacttcggcgcgcccccatgccctcttgtgcgcgtgcgcagaggcggaccgcaaggctagggcgtgagggaagggcgggcgtacgcccttgcgtgcgtctcaggcagcgcgcacgccggcgtgagagggcacggggaaaaggtggctctggccggggtggctcggtttcctggggctatgtaactgagctcgtcgacttaggggtccttcttcgctgccctcgccgcgtgctagcagggagtttccgctcgggagagagactgtcctcacgcccgctgcgcctcctcgacggcagagcaggcttgctcgcccgtgggagcgtcccggccgagaagccctgaggggggaggggaggccattttgtcccgaccgactccccggaaccgggcggagcggctgggagaggctgcggagccgcggtcgccgccctcggaggcactggacgccgccactgtcggggcttcctcaaagctgttcgtaggtcgcccgcgccgtctcgagcctttttcccacgcttccccggtcctccggcctgagaacgcccgagtgaggagttggccgtagtgagagggaccgatcccttggggccgccggcggcgagagcccgagccgctcctcccaatggcgaagaagacgtacgacctgcttttcaagctgctcctgatcggggatttcctcccccccggngggnaaagtttgggggggggaaaagaaccccggagtggggaagacctgcgtcctttttcgtttttcggatgatgccttcaatactacctttatttccaccataggagcaaaactgaatctcgaaagataaatgaagtttaccaggaaaagaaaactgggatgaggagaggatttacgaagtagcatatgctaaacgagagacatgagaaaacatgatgatcagggatgtcatgtagactgaagactttgatactaagaggcattttcacaattttatcctgaaagcatagagaaaacaaatcaacttgtcattttcaaaaacttaccctggctgtaatctcaataaaaggacatcttttaaagtca

SEQ ID NO: 307131 - DNA, 1293 bp, Homo sapiens
  misc_feature (191)..(191): n is a, c, g, or t
ccaaaatatcttccaaaccagctgcatctttctacaattctaccagcaatatatgagggttacaatttctctccatctttgtgaacgcttgttagagtctgtcctcttttcttccattctgtgggttggctttttactttctaaatggtagaaccttcaaagcacaaaggttttaaatttgatgtagcccnatttatccatttcttttcttttgccacttcatggctttagatcttacatgtaggtccatgatcctttttggttttttttcttttttttgagacagagtctcactctgttgcccaggctggagtgcagtcatgcaatcatggctcactgcagcctcgacctcccgggctcaagtgatcccacctcagcctcccagatagctggaaccacaagtgcataccaccatacccgactaattttttttttttttttatggatatttttgtttaaagagatggggactcgcagtgttgcccaggctggtctcaaactccaggggtcaagtgattcttccttctcagcctcccaagaagctgggattacaggtgtgtgccaccacacccagctctataaacaggtttttaaaaacaaatcttttggaaaaaatgttagagacttgcaacaatttgaaaaactcacagacaagccacataacctagaaatattgggcgggggggaaattaagaaaaagttaagtatattatgaatgtctaaagtatatgtagatactagtctattttattactaccataaaacatacacagatctattattaaaagtttaaatttattaacactcaaacacacagagcccatacaaggcaccttttgcatcaagagaaatgtaacagagatgcagtattaaatcataattgcataaaaataactaatacatactgtactactgtgataattttgtagccacctcctgttgctattttggtgagctcgtatgtttccaagtgtctgcttaaaacaccatgtgatgtggatcatctccccgtgaacagtttgtgtctccagtaaatcccatattgcaatcaagaaaaaaaaaccgtaaaaaatttcctatccataatttgtctatgaccaccaatttataaatgcttataatgtaaacacccactttttaatgaataaatatccgtaaactagcctgtactttatccgtgtagagctattgaatgtttgggcaggtttatctatatcctacggtggcatttctctgttagtggtccaacctttttatatgagttgttttttttattgtaccctgtgttacccc

SEQ ID NO: 307132 - DNA, 1624 bp, Homo sapiens
agggttttgccatgttggtcaggctggtctcaaactcctggcttcaagtgaatcacccatttcggcctcccagagtgctgggattacaggtgtgagccactgtgccaagccagcccctccagactcttgagactagtgttatttgctcagatgttgccagtgaaagtgtgagctacatccactggataaagcagctacttcatcccttgactcagccacagcagattatgaaatactgctttaagatatggagtagaaattcttgagtcaagatgaaaatcctgggatagggtttttacaagcagtgaagcataaattacaatgaagttacattgaggaagccacctgttaaagtggcttccttttttaaaatttggaacttggggcaatcttcccaagcagggtttactgcacgaggaacttaagccacagtcccagttatacagtggatcattggcaaagctgggaataggacccaggacgtctgcttccaatatgctactttttttttttttttgagacgtcttgccctgttgcccaggctagtatgcagtggcacagtcacagcttcctgcagccttgaccttctggctccagcaatcctcccagcttagcactccgtctcaaaaaacaaaaaaaaaatatcaatcctaagagagggaaggaggagactgaaagcataaagagggtagaaaagtcataaaatccacagggatacacaatggtctggattcttgcagtcacagtgttacataggaaagctcactctgggacaacagccctggagctcctgtagctagatagggacagtgtcacttgtaatcccagctacttggtaggcagaggttgcagtgagcagagatcaccccactgcactccagcctgggccacagagtgagactctgtctcaaaaaaaagaaaaacaaagatgggcagtgtcagggtggtttttcagaccctgaattgttgaatagatgggggatccagagccaactcaggcccccctactcccaaatgtcatcaaacagattgaattcctaagggcagatgggagcaatgggacgccttgacctctcagtctcttcacttgcagtcatcatgtggaaccgtggcctgtaccaaaacagtacctgatgaaagctgccattacagtatacaactgcaccccaggcctgcctcataccaaatcattctccttcctttccaggtacgagtgcttccatatccatttacccaccattggcaatttgaaaggaccatccagacccccataggatccacatggaacacccagagggctttccaaaagctgactactcccaaggtcgtcaccaagccaggccatatcattaaccccataaaagcagaagacgtgggctaccggtcttcctcaaggtcggacctgtctgtcatacagaggaatccaaaacgaatcaccacacgtcacaaaaaacagctgaagaaatgctctgtagattgagttgctggaggagtgacagccaggagccctgacttcacttcctttggtccagttttactctgatacagggtggattccaaaactggctcagtacattgcatgtagttaagccacattttaaaaataaaggcattttttaatcta

SEQ ID NO: 307133 - DNA, 2540 bp, Homo sapiens
aaattgctttgcggcccgcacggaaattgctttccttcggcttccgttcttggtccatgtgagagaagctggctgctgaaatgactgcgaaccggcttgcagagagccttctggctttgagccaacaggaagaactagcggatttgccaaaagactacctcttgagtgagagtgaagatgagggggacaatgatggagagagaaagcatcaaaagcttctggaagcaatcagttcccttgatggaaagaataggcggaaattggctgagaggtctgaggctagtctgaaggtgtcagagttcaatgtcagttctgaaggatcaggagaaaagctggtccttgcagatctgcttgagcctgttaaaacttcatcttctttggccactgtgaaaaagcaactgagtagagtcaaatcaaagaagacagtggagttacctctgaacaaagaagagattgaacggatccacagagaagtagcattcaataaaaccgcacaagtcctctccaaatgggaccctgtcgtcctgaagaaccggcaggcagagcagctggtttttcccctggagaaagaggagccagccattgctcccattgaacatgtgctcagtggctggaaggcaagaactcccctggagcaggaaattttcaacctcctccataagaacaagcagccagtgacagaccctttactgacccctgtggaaaaggcctctctccgagccatgagcctagaagaggcaaagatgcgacgagcagagcttcagagggctcgggctctgcagtcctactatgaggccaaggctcgaagagagaagaaaatcaaaagtaaaaagtatcacaaagtcgtgaagaaaggaaaggccaagaaagccctaaaagagtttgagcagctgcggaaggttaatccagctgcagcactagaagaactggaaaaaattgaaaaggccagaatgatggaaagaatgagccttaagcaccaaaacagtgggaaatgggccaagtcaaaggcaattatggccaaatatgacctggaggctcgccaagctatgcaggaacagttgtctaagaacaaagaactgacacagaaactccaggtagcctctgagagtgaggaagaggagggaggcacagaagatgtggaagaactccttgtccctgatgtagtgaatgaagtgcagatgaatgcagatgggccgaatccctggatgctcaggagctgcaccagtgacaccaaagaggctgcaacccaggaggaccctgagcaactgccagagcttgaggcccatggagtttctgaaagtgagggagaagaaagaccagtggcagaagaagaaattttgttgagagaatttgaggaaaggcgatcccttagaaaaagatctgagctcagccaagatgctgagccagcaggcagtcaagaaacaaaagattctggcagccaggaggtgctgtctgaattgagagtactatctcagaaattgaaggaaaaccatcagtccaggaagcaaaaagcaagttcagaggggactattccccaggtccagagagaggaacctgccccagaagaagaggagcccctgttgctacagagaccagagagagtacagacgctggaagagctagaagagctgggaaaagaagaatgttttcaaaataaggagcttcccagacctgtgttagaagggcagcagtcagagaggaccccaaataatcgccctgatgcccctaaggagaagaaaaagaaggagcaaatgatcgacctacagaacctcctaaccacacaatctccctccgtgaagtctttggcagttcccacaatagaggagctggaagatgaagaggagagaaaccataggcagatgataaaggaagcttttgctggggatgatgtcatcagagatttcttgaaagagaagagggaagctgtggaggcgagtaagccaaaggacgtggacctgacactacctggctggggcgagtggggtggtgtgggcctaaagcccagtgccaagaaaagacgccggtttctcattaaagcccctgagggtcctccaagaaaagataagaatttgccaaatgtgattatcaatgagaagcgcaacatccacgcagctgctcatcaggtacgagtgcttccatatccatttacccaccattggcaatttgaaaggaccatccagacccccataggatccacatggaacacccagagggctttccaaaagctgactactcccaaggtcgtcaccaagccaggccatatcattaaccccataaaagcagaagacgtgggctaccggtcttcctcaaggtcggacctgtctgtcatacagaggaatccaaaacgaatcaccacacgtcacaaaaaacagctgaagaaatgctctgtagattgagttgctggaggagtgacagccaggagccctgacttcacttcctttggtccagttttactctgatacagggtggattccaaaactggctcagtacattgcatgtagttaagccacattttaaaaataaaggcattttttaatcta

SEQ ID NO: 307134 - DNA, 2438 bp, Homo sapiens
aaattgctttgcggcccgcacggaaattgctttccttcggcttccgttcttggtccatgtgagagaagctggctgctgaaatgactgcgaaccggcttgcagagagccttctggctttgagccaacaggaagaactagcggatttgccaaaagactacctcttgagtgagagtgaagatgagggggacaatgatggagagagaaagcatcaaaagcttctggaagcaatcagttcccttgatggaaagaataggcggaaattggctgagaggtctgaggctagtctgaaggtgtcagagttcaatgtcagttctgaaggatcaggagaaaagctggtccttgcagatctgcttgagcctgttaaaacttcatcttctttggccactgtgaaaaagcaactgagtagagtcaaatcaaagaagacagtggagttacctctgaacaaagaagagattgaacggatccacagagaagtagcattcaataaaaccgcacaagtcctctccaaatgggaccctgtcgtcctgaagaaccggcaggcagagcagctggtttttcccctggagaaagaggagccagccattgctcccattgaacatgtgctcagtggctggaaggcaagaactcccctggagcaggaaattttcaacctcctccataagaacaagcagccagtgacagaccctttactgacccctgtggaaaaggcctctctccgagccatgagcctagaagaggcaaagatgcgacgagcagagcttcagagggctcgggctctgcagtcctactatgaggccaaggctcgaagagagaagaaaatcaaaagtaaaaagtatcacaaagtcgtgaagaaaggaaaggccaagaaagccctaaaagagtttgagcagctgcggaaggttaatccagctgcagcactagaagaactggaaaaaattgaaaaggccagaatgatggaaagaatgagccttaagcaccaaaacagtgggaaatgggccaagtcaaaggcaattatggccaaatatgacctggaggctcgccaagctatgcaggaacagttgtctaagaacaaagaactgacacagaaactccaggtagcctctgagagtgaggaagaggagggaggcacagaagatgtggaagaactccttgaccctgagcaactgccagagcttgaggcccatggagtttctgaaagtgagggagaagaaagaccagtggcagaagaagaaattttgttgagagaatttgaggaaaggcgatcccttagaaaaagatctgagctcagccaagatgctgagccagcaggcagtcaagaaacaaaagattctggcagccaggaggtgctgtctgaattgagagtactatctcagaaattgaaggaaaaccatcagtccaggaagcaaaaagcaagttcagaggggactattccccaggtccagagagaggaacctgccccagaagaagaggagcccctgttgctacagagaccagagagagtacagacgctggaagagctagaagagctgggaaaagaagaatgttttcaaaataaggagcttcccagacctgtgttagaagggcagcagtcagagaggaccccaaataatcgccctgatgcccctaaggagaagaaaaagaaggagcaaatgatcgacctacagaacctcctaaccacacaatctccctccgtgaagtctttggcagttcccacaatagaggagctggaagatgaagaggagagaaaccataggcagatgataaaggaagcttttgctggggatgatgtcatcagagatttcttgaaagagaagagggaagctgtggaggcgagtaagccaaaggacgtggacctgacactacctggctggggcgagtggggtggtgtgggcctaaagcccagtgccaagaaaagacgccggtttctcattaaagcccctgagggtcctccaagaaaagataagaatttgccaaatgtgattatcaatgagaagcgcaacatccacgcagctgctcatcaggtacgagtgcttccatatccatttacccaccattggcaatttgaaaggaccatccagacccccataggatccacatggaacacccagagggctttccaaaagctgactactcccaaggtcgtcaccaagccaggccatatcattaaccccataaaagcagaagacgtgggctaccggtcttcctcaaggtcggacctgtctgtcatacagaggaatccaaaacgaatcaccacacgtcacaaaaaacagctgaagaaatgctctgtagattgagttgctggaggagtgacagccaggagccctgacttcacttcctttggtccagttttactctgatacagggtggattccaaaactggctcagtacattgcatgtagttaagccacattttaaaaataaaggcattttttaatcta

SEQ ID NO: 307135 - DNA, 2507 bp, Homo sapiens
aaattgctttgcggcccgcacggaaattgctttccttcggcttccgttcttggtccatgtgagagaagctggctgctgaaatgactgcgaaccggcttgcagagagccttctggctttgagccaacaggaagaactagcggatttgccaaaagactacctcttgagtgagagtgaagatgagggggacaatgatggagagagaaagcatcaaaagcttctggaagcaatcagttcccttgatggaaagaataggcggaaattggctgagaggtctgaggctagtctgaaggtgtcagagttcaatgtcagttctgaaggatcaggagaaaagctggtccttgcagatctgcttgagcctgttaaaacttcatcttctttggccactgtgaaaaagcaactgagtagagtcaaatcaaagaagacagtggagttacctctgaacaaagaagagattgaacggatccacagagaagtagcattcaataaaaccgcacaagtcctctccaaatgggaccctgtcgtcctgaagaaccggcaggcagagcagctggtttttcccctggagaaagaggagccagccattgctcccattgaacatgtgctcagtggctggaaggcaagaactcccctggagcaggaaattttcaacctcctccataagaacaagcagccagtgacagaccctttactgacccctgtggaaaaggcctctctccgagccatgagcctagaagaggcaaagatgcgacgagcagagcttcagagggctcgggctctgcagtcctactatgaggccaaggctcgaagagagaagaaaatcaaaagtaaaaagtatcacaaagtcgtgaagaaaggaaaggccaagaaagccctaaaagagtttgagcagctgcggaaggttaatccagctgcagcactagaagaactggaaaaaattgaaaaggccagaatgatggaaagaatgagccttaagcaccaaaacagtgggaaatgggccaagtcaaaggcaattatggccaaatatgacctggaggctcgccaagctatgcaggaacagttgtctaagaacaaagaactgacacagaaactccaggtagcctctgagagtgaggaagaggagggaggcacagaagatgtggaagaactccttgtccctgatgtagtgaatgaagtgcagatgaatgcagatgggccgaatccctggatgctcaggagctgcaccagtgacaccaaagaggctgcaacccaggaggaccctgagcaactgccagagcttgaggcccatggagtttctgaaagtgagggagaagaaagaccagtggcagaagaagaaattttgttgagagaatttgaggaaaggcgatcccttagaaaaagatctgagctcagccaagatgctgagccagcaggcagtcaagaaacaaaagattctggcagccaggaggtgctgtctgaattgagagtactatctcagaaattgaaggaaaaccatcagtccaggaagcaaaaagcaagttcagaggggactattccccaggtccagagagaggaacctgccccagaagaagaggagcccctgttgctacagagaccagagagagtacagacgctggaagagctagaagagctgggaaaagaagaatgttttcaaaataaggagcttcccagacctgtgttagaagggcagcagtcagagaggaccccaaataatcgccctgatgcccctaaggagaagaaaaagaaggagcaaatgatcgacctacagaacctcctaaccacacaatctccctccgtgaagtctttggcagttcccacaatagaggagctggaagatgaagaggagagaaaccataggcagatgataaaggaagcttttgctggggatgatgtcatcagagatttcttgaaagagaagagggaagctgtggaggcgagtaagccaaaggacgtggacctgacactacctggctggggcgagtggggtggtgtgggcctaaagcccagtgccaagaaaagacgccgaaaagataagaatttgccaaatgtgattatcaatgagaagcgcaacatccacgcagctgctcatcaggtacgagtgcttccatatccatttacccaccattggcaatttgaaaggaccatccagacccccataggatccacatggaacacccagagggctttccaaaagctgactactcccaaggtcgtcaccaagccaggccatatcattaaccccataaaagcagaagacgtgggctaccggtcttcctcaaggtcggacctgtctgtcatacagaggaatccaaaacgaatcaccacacgtcacaaaaaacagctgaagaaatgctctgtagattgagttgctggaggagtgacagccaggagccctgacttcacttcctttggtccagttttactctgatacagggtggattccaaaactggctcagtacattgcatgtagttaagccacattttaaaaataaaggcattttttaatcta

SEQ ID NO: 307136 - DNA, 1370 bp, Homo sapiens
  misc_feature (1130)..(1130): n is a, c, g, or t
  misc_feature (1173)..(1173): n is a, c, g, or t
  misc_feature (1216)..(1216): n is a, c, g, or t
aaattgctttgcggcccgcacggaaattgctttccttcggcttccgttcttggtccatgtgagagaagctggctgctgaaatgactgcgaaccggcttgcagagagccttctggctttgagccaacaggaagaactagcggatttgccaaaagactacctcttgagtgagagtgaagatgagggggacaatgatggagagagaaagcatcaaaagcttctggaagcaatcagttcccttgatggaaagaataggcggaaattggctgagaggtctgaggctagtctgaaggtgtcagagttcaatgtcagttctgaaggatcaggagaaaagctggtccttgcagatctgcttgagcctgttaaaacttcatcttctttggccactgtgaaaaagcaactgagtagagtcaaatcaaagaagacagtggagttacctctgaacaaagaagagattgaacggatccacagagaagtagcattcaataaaaccgcacaagtcctctccaaatgggaccctgtcgtcctgaagaaccggcaggcagagcagctggtttttcccctggagaaagaggagccagccattgctcccattgaacatgtgctcagtggctggaaggcaagaactcccctggagcaggaaattttcaacctcctccataagaacaagcagccagtgacagaccctttactgacccctgtggaaaaggcctctctccgagccatgagcctagaagaggcaaagatgcgacgagcagagcttcagagggctcgggctctgcagtcctactatgaggccaaggctcgaagagagaagaaaatcaaaagtaaaaagtatcacaaagtcgtgaagaaaggaaaggccaagaaagccctaaaagagtttgagcagctgcggaaggttaatccagctgcagcactagaagaacgaagaaaagaggaaagaaggaggaggagaaagaagaagaacaaggagaagaagaaagaagaagggagaaggagaagaaaagaaggagaagaggaaaaggaagaaggagaaagaaaaggagaaggaaaaggaaaagaaggagaagaaagaagaactaagaagaaggagaggaagaataagaaggaaagaagaaagaaaaaagtnaaagaagaagaaagaaggaagaaggaaagaagaggaagaactnagaagaagaaagaggaggaaagaagaaagaagaataaggaacnagaaagaaggagaagaaagaataagaagaggaagaagaaaaagaagaaaagaagaaggaaagaaggagaaaaaggaagaaaaaaggaagaagaaagtagaaagcggaagaaagaaaagaaagtataagaaggaagaagaagaaagaaggaaaaa

SEQ ID NO: 307137 - DNA, 794 bp, Homo sapiens
taaccagtggttatttccaggatgaagagtgtgtgcgccttgataaagagagattggctgcccgtttggagggtcacaaagaagggattgtacagactgaacagattaggtctttgtctgaagctatgtcagtggaaaaaattgctgcaatcaaagccaaaattatggctaagaaaagatctactatcaagactgatctagatgatgacataactgcccttaaacagaggagttttgtggatgctgaggtagatgtgacccgagatattgtcagcagagagagagtatggaggacacgaacaactatcttacaaagcacaggaaagaatttttccaagaacatttttgcaattcttcaatctgtaaaagccagagaagaagggcgtgcacctgaacagcgacctgccccaaatgcagcacctgtggatcccactttgcgcaccaaacagcctatcccagctgcctctgctccctctgaaaaaaaaaaaaaaaaaaaaaaaaaaaaaaaaaaaaaaaaaaaaaaaaaaaaaaaaaaaagaaaaaaaaaaaaaaaaaaaaaaagagacaaaagaagaatcaaaagaagagcaacaaaacaagaaaaaccaaaaaagagactagaaaaaagaggaaagaagaaaaaacacagaagacaaaaaagacaacaagagaacgaaaaaaaagaaaagaagaggagaaaaaaaaagaagaagaaaggaacacaaccataaaaaaaaaaagaacagaaaagacgacgagagaagaggcaaaaaaagaaggggaaaaaaccaaaa

SEQ ID NO: 307138 - DNA, 430 bp, Homo sapiens
  misc_feature (390)..(390): n is a, c, g, or t
tggttagtgctgctgctgttggttcgtcgcggcggcgaaggaggaggaggaagagggcgaggcgacaagagaagaaggaggcaggcgcggcggcagcggcggcgccccgagccggcggaggcgaggggggggaagatggcggacgtgcttagcgtcctgcgacagtacaacatccagaagaaggagattgtggtgaagggagacgaagtgatcttcggggagttctcctggcccaagaatgtgaagaccaactatgttgtttgggggactggaaaggaaggccaacccagagagtactacacattggattccattttatttctacttaataacgtgcacctttctcatcctgtttatgtccgacgtgcagctacttaaaaaaaaccgttnttttaaaaaacgcataactaaaataactacaattaaagcg

SEQ ID NO: 307139 - DNA, 2760 bp, Homo sapiens
tggttagtgctgctgctgttggttcgtcgcggcggcgaaggaggaggaggaagagggcgaggcgacaagagaagaaggaggcaggcgcggcggcagcggcggcgccccgagccggcggaggcgaggggggggaagatggcggacgtgcttagcgtcctgcgacagtacaacatccagaagaaggagattgtggtgaagggagacgaagtgatcttcggggagttctcctggcccaagaatgtgaagaccaactatgttgtttgggggactggaaaggaaggccaacccagagagtactacacattggattccattttatttctacttaataacgtgcacctttctcatcctgtttatgtccgacgtgcagctactgaaaatattcctgtggttagaagacctgatcgaaaagatctacttggatatctcaatggtgaagcgtcaacatcggcaagtatagacagaagcgctcccttagaaataggtcttcagcgatctactcaagtcaaacgagctgcagatgaagttttagcagaagcaaagaaaccacgaattgaggatgaagagtgtgtgcgccttgataaagagagattggctgcccgtttggagggtcacaaagaagggattgtacagactgaacagattaggtctttgtctgaagctatgtcagtggaaaaaattgctgcaatcaaagccaaaattatggctaagaaaagatctactatcaagactgatctagatgatgacataactgcccttaaacagaggagttttgtggatgctgaggtagatgtgacccgagatattgtcagcagagagagagtatggaggacacgaacaactatcttacaaagcacaggaaagaatttttccaagaacatttttgcaattcttcaatctgtaaaagccagagaagaagggcgtgcacctgaacagcgacctgccccaaatgcagcacctgtggatcccactttgcgcaccaaacagcctatcccagctgcctataacagatacgatcaggaaagattcaaaggaaaagaagaaacggaaggcttcaaaattgacactatgggaacctaccatggtatgacactgaaatctgtaacggagggtgcatctgcccggaagactcagactcctgcagcccagccagtaccaagaccagtttctcaagcaagacctcccccaaatcagaagaaaggatctcgaacacccattatcataattcctgcagctaccacctctttaataaccatgcttaatgcaaaagaccttctacaggacctgaaatttgtcccatcagatgaaaagaagaaacaaggttgtcaacgagaaaatgaaactctaatacaaagaagaaaagaccagatgcaaccagggggcactgcaattagtgttacagtaccttatagagtagtagaccagccccttaaacttatgcctcaagactgggaccgcgttgtagccgtttttgtgcagggtcctgcatggcagttcaaaggttggccatggcttttgcctgatggatcaccagttgatatatttgctaaaattaaagccttccatctgaagtatgatgaagttcgtctggatccaaatgttcagaaatgggatgtaacagtattagaactcagctatcacaaacgtcatttggatagaccagtgttcttacggttttgggaaacattggacaggtacatggtaaagcataaatcgcacttgagattctgaattatttggctcctccatttctggaaattgagactcaagctttatgaatttatcaagaacttaaaaatgaagaaggtcacagattgatcttttataagaccttatttgatgctttgtgcttcaaggagatgatacctgtcatccatataagcaaactttttggcttacaactatttttttaatattagccttctagtctgtaatggaaattgtatattttgatagaagttttttctccattggttaaattagcattacttaaaatttgtttctttagaaaataaatgcaggttataaatgtgtgtatatttagagattataaggctctctgagccatcttctgatttttcattgctctataattctttttactgaaaatactatgttatgaatggtattaaattttagtctctggaacatccaaaaccaagcaaagggatgtgactattttgaatgaatcagaatgtcaacttgtatgtacactatatctacacttactcattatttaaaaagaataatgaaaaatctagatcaattcttcaatttgattgaactgttcagccttttcaagatttctttatttacaaatgattacatttaaatgaatgtacattcttctcactgactttggtgattttgaaacctagaatgatgtgtttctatctgtaatatctttccatttgaaaaaaatctcaaaacacagattaaaaccacaataggctgtagtattttttattttgggagccagagtatgatttgggggaagaatatgtatcagccctattgcagtataactttaagctccttttctctttagtccacttttgattgtaatttttatggtataggattttgaatcttctattttaggcttgtcagtcttggagttcttatcttccattatccctaaatattgataaactcccaggcaccaaagaaaacatttgcttaattgtctgaaaagaaacaagagaaaaacactggtatttttatgtctgtattcaatatggtataaaatataaaaactat

SEQ ID NO: 307140 - DNA, 3800 bp, Homo sapiens
tggttagtgctgctgctgttggttcgtcgcggcggcgaaggaggaggaggaagagggcgaggcgacaagagaagaaggaggcaggcgcggcggcagcggcggcgccccgagccggcggaggcgaggggggggaagatggcggacgtgcttagcgtcctgcgacagtacaacatccagaagaaggagattgtggtgaagggagacgaagtgatcttcggggagttctcctggcccaagaatgtgaagaccaactatgttgtttgggggactggaaaggaaggccaacccagagagtactacacattggattccattttatttctacttaataacgtgcacctttctcatcctgtttatgtccgacgtgcagctactgaaaatattcctgtggttagaagacctgatcgaaaagatctacttggatatctcaatggtgaagcgtcaacatcggcaagtatagacagaagcgctcccttagaaataggtcttcagcgatctactcaagtcaaacgagctgcagatgaagttttagcagaagcaaagaaaccacgaattgaggatgaagagtgtgtgcgccttgataaagagagattggctgcccgtttggagggtcacaaagaagggattgtacagactgaacagattaggtctttgtctgaagctatgtcagtggaaaaaattgctgcaatcaaagccaaaattatggctaagaaaagatctactatcaagactgatctagatgatgacataactgcccttaaacagaggagttttgtggatgctgaggtagatgtgacccgagatattgtcagcagagagagagtatggaggacacgaacaactatcttacaaagcacaggaaagaatttttccaagaacatttttgcaattcttcaatctgtaaaagccagagaagaagggcgtgcacctgaacagcgacctgccccaaatgcagcacctgtggatcccactttgcgcaccaaacagcctatcccagctgcctataacagatacgatcaggaaagattcaaaggaaaagaagaaacggaaggcttcaaaattgacactatgggaacctaccatggtatgacactgaaatctgtaacggagggtgcatctgcccggaagactcagactcctgcagcccagccagtaccaagaccagtttctcaagcaagacctcccccaaatcagaagaaaggatctcgaacacccattatcataattcctgcagctaccacctctttaataaccatgcttaatgcaaaagaccttctacaggacctgaaatttgtcccatcagatgaaaagaagaaacaaggttgtcaacgagaaaatgaaactctaatacaaagaagaaaagaccagatgcaaccagggggcactgcaattagtgttacagtaccttatagagtagtagaccagccccttaaacttatgcctcaagactgggaccgcgttgtagccgtttttgtgcagggtcctgcatggcagttcaaaggttggccatggcttttgcctgatggatcaccagttgatatatttgctaaaattaaagccttccatctgaagtatgatgaagttcgtctggatccaaatgttcagaaatgggatgtaacagtattagaactcagctatcacaaacgtcatttggatagaccagtgttcttacggttttgggaaacattggacaggtacatggtaaagcataaatcgcacttgagattctgaattatttggctcctccatttctggaaattgagactcaagctttatgaatttatcaagaacttaaaaatgaagaaggtcacagattgatcttttataagaccttatttgatgctttgtgcttcaaggagatgatacctgtcatccatataagcaaactttttggcttacaactatttttttaatattagccttctagtctgtaatggaaattgtatattttgatagaagttttttctccattggttaaattagcattacttaaaatttgtttctttagaaaataaatgcaggttataaatgtgtgtatatttagagattataaggctctctgagccatcttctgatttttcattgctctataattctttttactgaaaatactatgttatgaatggtattaaattttagtctctggaacatccaaaaccaagcaaagggatgtgactattttgaatgaatcagaatgtcaacttgtatgtacactatatctacacttactcattatttaaaaagaataatgaaaaatctagatcaattcttcaatttgattgaactgttcagccttttcaagatttctttatttacaaatgattacatttaaatgaatgtacattcttctcactgactttggtgattttgaaacctagaatgatgtgtttctatctgtaatatctttccatttgaaaaaaatctcaaaacacagattaaaaccacaaaaaaaaaaaaaaaactcgagactagttctctccctcgtgccgaattcggcacgaggcctcgtgccgtctctctgggtttcttgttcactaaggagtaacacagaggtcaggcagagaatgggggtctcgcaggctagggacctcagggagaggcctctgttgcccttttcagcaaggctggaaatgggatatgggcaggggacgtcttctctgacttcaccctagaccttctggctccaaatggggcccatggccttgagcacctgggaccagctctttccaccacagggcattgggcactgggcactttcttatcgagatagtcactcccacgtctggttcgtgatgggcttggccctccagctcagcacaactgcaagaatggattttgtattctctagacggacactgtccaagatggtagccattggccacatgcgacacatttttaatgaattaaaattaatcaagactggaaatgtcggccaggcctggtggctcatgcctgtaatcccagcactttgggaggccatagagggcggatgacttgaggtcaggagtttaagaccagcctggccaacatggtgaaacccatttctactaaaaacacaaaaattagctgggcatggtggtgtgttcctgtaatcccagctgcttgggaggctgaggcaggagaatcgcttgaacccaggaggcagagattggagtgagctgagatcatgccactgccctccagtggccaccacatccggcaaggcagatgggaccatttccttcatccagaacgttctgtggacatcactgctctaggttcctcccttatggagtctcacaagactgtctagccagcaagatctcttttccaaccaggccaggagcacctctccacccactgctgctggtctgaccgccttcctggaagtccctcttgaggcaggccctggagttagaagctgggcagaggcacccacagccttatcctttgccaatctctgactcaatgccacggccactgtagtgagctgaaccacctccagcagtcccctggcagaagcacctggaaaacatgcaatgggaaccttcaccctgaggccaggcccttcccatgctacccaacagtagacaggacaccctgtgttgttggctgcaccggggtgctgggatctgtggatccctggggcctggaagccactctcagcacatacagccactgtgttccgaggtccagtcagctggccgggaaggaattcaacacagccaaggacagaggtccatatgatgacgggtggatgctcgtgtgactttgctgaccttttatgttttctatgggcaataaaggccaagagagctccc

SEQ ID NO: 307141 - DNA, 3376 bp, Homo sapiens
tggttagtgctgctgctgttggttcgtcgcggcggcgaaggaggaggaggaagagggcgaggcgacaagagaagaaggaggcaggcgcggcggcagcggcggcgccccgagccggcggaggcgaggggggggaagatggcggacgtgcttagcgtcctgcgacagtacaacatccagaagaaggagattgtggtgaagggagacgaagtgatcttcggggagttctcctggcccaagaatgtgaagaccaactatgttgtttgggggactggaaaggaaggccaacccagagagtactacacattggattccattttatttctacttaataacgtgcacctttctcatcctgtttatgtccgacgtgcagctactgaaaatattcctgtggttagaagacctgatcgaaaagatctacttggatatctcaatggtgaagcgtcaacatcggcaagtatagacagaagcgctcccttagaaataggtcttcagcgatctactcaagtcaaacgagctgcagatgaagttttagcagaagcaaagaaaccacgaattgaggatgaagagtgtgtgcgccttgataaagagagattggctgcccgtttggagggtcacaaagaagggattgtacagactgaacagattaggtctttgtctgaagctatgtcagtggaaaaaattgctgcaatcaaagccaaaattatggctaagaaaagatctactatcaagactgatctagatgatgacataactgcccttaaacagaggagttttgtggatgctgaggtagatgtgacccgagatattgtcagcagagagagagtatggaggacacgaacaactatcttacaaagcacaggaaagaatttttccaagaacatttttgcaattcttcaatctgtaaaagccagagaagaagggcgtgcacctgaacagcgacctgccccaaatgcagcacctgtggatcccactttgcgcaccaaacagcctatcccagctgcctataacagatacgatcaggaaagattcaaaggaaaagaagaaacggaaggcttcaaaattgacactatgggaacctaccatggtatgacactgaaatctgtaacggagggtgcatctgcccggaagactcagactcctgcagcccagccagtaccaagaccagtttctcaagcaagacctcccccaaatcagaagaaaggatctcgaacacccattatcataattcctgcagctaccacctctttaataaccatgcttaatgcaaaagaccttctacaggacctgaaatttgtcccatcagatgaaaagaagaaacaaggttgtcaacgagaaaatgaaactctaatacaaagaagaaaagaccagatgcaaccagggggcactgcaattagtgttacagtaccttatagagtagtagaccagccccttaaacttatgcctcaagactgggaccgcgttgtagccgtttttgtgcagggtcctgcatggcagttcaaaggttggccatggcttttgcctgatggatcaccagttgatatatttgctaaaattaaagccttccatctgaagtatgatgaagttcgtctggatccaaatgttcagaaatgggatgtaacagtattagaactcagctatcacaaacgtcatttggatagaccagtgttcttacggttttgggaaacattggacaggtacatggtaaagcataaatcgcacttgagattctgaattatttggctcctccatttctggaaattgagactcaagctttatgaatttatcaagaacttaaaaatgaagaaggtcacagattgatcttttataagaccttatttgatgctttgtgcttcaaggagatgatacctgtcatccatataagcaaactttttggcttacaactatttttttaatattagccttctagtctgtaatggaaattgtatattttgatagaagttttttctccattggttaaattagcattacttaaaatttgtttctttagaaaataaatgcaggttataaatgtgtgtatatttagagattataaggctctctgagccatcttctgatttttcattgctctataattctttttactgaaaatactatgttatgaatggtattaaattttagtctctggaacatccaaaaccaagcaaagggatgtgactattttgaatgaatcagaatgtcaacttgtatgtacactatatctacacttactcattatttaaaaagaataatgaaaaatctagatcaattcttcaatttgattgaactgttcagccttttcaagatttctttatttacaaatgattacatttaaatgaatgtacattcttctcactgactttggtgattttgaaacctagaatgatgtgtttctatctgtaatatctttccatttgaaaaaaatctcaaaacacagattaaaaccacaataggctgtagtattttttattttgggagccagagtatgatttgggggaagaatatgtatcagccctattgcagtataactttaagctccttttctctttagtccacttttgattgtaatttttatggtataggattttgaatcttctattttaggcttgtcagtcttggagttcttatcttccattatccctaaatattgataaactcccaggcaccaaagaaaacatttgcttaattgtctgaaaagaaacaagagaaaaacactggtatttttatgtctgtattcaatatggtataaaatataaaaactatattttaacttagtgaaatattttactatttctctacttcagacaaaatgttgcatccaaggtacatcaagtgaccatttgccttgaaccttgatttcactttgttttttttttttccttaaaggcaactaggaagctttactttcctaaagtgtttttgccattggaatttttgctgatcacagtcttatgtcatttttttctctgtttttattcccagcaattttctcctaggttaacatatttttggtgaacgtttaggcctttcataggtattaagctgacattatctagcttcttaatgaaatttaacactgtcacaaaaatgagaagttattattttttaagtgatcacatagttcataccactagtaactagaaaagatatttattcacatgatatttacaaggctcttcagaagggaacagtcagcattttaaattactagattttagcatacttaacaaggtttgaacagattctacccctattttcctccctttttagcgtcttctttccttaaagataaaagaaaactcaaatttgtttacattaggctttcttagcatataaatatatttccaaaataaattacatgttgtgtaaactttctcca

SEQ ID NO: 307142 - DNA, 3275 bp, Homo sapiens
tggttagtgctgctgctgttggttcgtcgcggcggcgaaggaggaggaggaagagggcgaggcgacaagagaagaaggaggcaggcgcggcggcagcggcggcgccccgagccggcggaggcgaggggggggaagatggcggacgtgcttagcgtcctgcgacagtacaacatccagaagaaggagattgtggtgaagggagacgaagtgatcttcggggagttctcctggcccaagaatgtgaagaccaactatgttgtttgggggactggaaaggaaggccaacccagagagtactacacattggattccattttatttctacttaataacgtgcacctttctcatcctgtttatgtccgacgtgcagctactgaaaatattcctgtggttagaagacctgatcgaaaagatctacttggatatctcaatggtgaagcgtcaacatcggcaagtatagacagaagcgctcccttagaaataggtcttcagcgatctactcaagtcaaacgagctgcagatgaagttttagcagaagcaaagaaaccacgaattgaggatgaagagtgtgtgcgccttgataaagagagattggctgcccgtttggagggtcacaaagaagggattgtacagactgaacagattaggtctttgtctgaagctatgtcagtggaaaaaattgctgcaatcaaagccaaaattatggctaagaaaagatctactatcaagactgatctagatgatgacataactgcccttaaacagaggagttttgtggatgctgaggtagatgtgacccgagatattgtcagcagagagagagtatggaggacacgaacaactatcttacaaagcacaggaaagaatttttccaagaacatttttgcaattcttcaatctgtaaaagccagagaagaagggcgtgcacctgaacagcgacctgccccaaatgcagcacctgtggatcccactttgcgcaccaaacagcctatcccagctgcctataacagatacgatcaggaaagattcaaaggaaaagaagaaacggaaggcttcaaaattgacactatgggaacctaccatggtatgacactgaaatctgtaacggagggtgcatctgcccggaagactcagactcctgcagcccagccagtaccaagaccagtttctcaagcaagacctcccccaaatcagaagaaaggatctcgaacacccattatcataattcctgcagctaccacctctttaataaccatgcttaatgcaaaagaccttctacaggacctgaaatttgtcccatcagatgaaaagaagaaacaaggttgtcaacgagaaaatgaaactctaatacaaagaagaaaagaccagatgcaaccagggggcactgcaattagtgttacagtaccttatagagtagtagaccagccccttaaacttatgcctcaagactgttaaagccttccatctgaagtatgatgaagttcgtctggatccaaatgttcagaaatgggatgtaacagtattagaactcagctatcacaaacgtcatttggatagaccagtgttcttacggttttgggaaacattggacaggtacatggtaaagcataaatcgcacttgagattctgaattatttggctcctccatttctggaaattgagactcaagctttatgaatttatcaagaacttaaaaatgaagaaggtcacagattgatcttttataagaccttatttgatgctttgtgcttcaaggagatgatacctgtcatccatataagcaaactttttggcttacaactatttttttaatattagccttctagtctgtaatggaaattgtatattttgatagaagttttttctccattggttaaattagcattacttaaaatttgtttctttagaaaataaatgcaggttataaatgtgtgtatatttagagattataaggctctctgagccatcttctgatttttcattgctctataattctttttactgaaaatactatgttatgaatggtattaaattttagtctctggaacatccaaaaccaagcaaagggatgtgactattttgaatgaatcagaatgtcaacttgtatgtacactatatctacacttactcattatttaaaaagaataatgaaaaatctagatcaattcttcaatttgattgaactgttcagccttttcaagatttctttatttacaaatgattacatttaaatgaatgtacattcttctcactgactttggtgattttgaaacctagaatgatgtgtttctatctgtaatatctttccatttgaaaaaaatctcaaaacacagattaaaaccacaataggctgtagtattttttattttgggagccagagtatgatttgggggaagaatatgtatcagccctattgcagtataactttaagctccttttctctttagtccacttttgattgtaatttttatggtataggattttgaatcttctattttaggcttgtcagtcttggagttcttatcttccattatccctaaatattgataaactcccaggcaccaaagaaaacatttgcttaattgtctgaaaagaaacaagagaaaaacactggtatttttatgtctgtattcaatatggtataaaatataaaaactatattttaacttagtgaaatattttactatttctctacttcagacaaaatgttgcatccaaggtacatcaagtgaccatttgccttgaaccttgatttcactttgttttttttttttccttaaaggcaactaggaagctttactttcctaaagtgtttttgccattggaatttttgctgatcacagtcttatgtcatttttttctctgtttttattcccagcaattttctcctaggttaacatatttttggtgaacgtttaggcctttcataggtattaagctgacattatctagcttcttaatgaaatttaacactgtcacaaaaatgagaagttattattttttaagtgatcacatagttcataccactagtaactagaaaagatatttattcacatgatatttacaaggctcttcagaagggaacagtcagcattttaaattactagattttagcatacttaacaaggtttgaacagattctacccctattttcctccctttttagcgtcttctttccttaaagataaaagaaaactcaaatttgtttacattaggctttcttagcatataaatatatttccaaaataaattacatgttgtgtaaactttctcca

SEQ ID NO: 307143 - DNA, 1254 bp, Homo sapiens
atcaattcttcaatttgattgaactagatttttcattattcttttcaaataatgagataagtgtagatatagtgtacatacaatgttgacattatatctacacttactcattatttaaaaagaataatgaaaaatctagatcaattcttcaatttgattgaactgttcagccttttcaagatttctttatttacaaatgattacatttaaatgaatgtacattcttctcactgactttggtgattttgaaacctagaatgatgtgtttctatctgtaatatctttccatttgaaaaaaatctcaaaacacagattaaaaccacaataggctgtagtattttttattttgggagccagagtatgatttgggggaagaatatgtatcagccctattgcagtataactttaagctccttttctctttagtccacttttgattgtaatttttatggtataggattttgaatcttctattttaggcttgtcagtcttggagttcttatcttccattatccctaaatattgataaactcccaggcaccaaagaaaacatttgcttaattgtctgaaaagaaacaagagaaaaacactggtatttttatgtctgtattcaatatggtataaaatataaaaactatattttaacttagtgaaatattttactatttctctacttcagacaaaatgttgcatccaaggtacatcaagtgaccatttgccttgaaccttgatttcactttgttttttttttttccttaaaggcaactaggaagctttactttcctaaagtgtttttgccattggaatttttgctgatcacagtcttatgtcatttttttctctgtttttattcccagcaattttctcctaggttaacatatttttggtgaacgtttaggcctttcataggtattaagctgacattatctagcttcttaatgaaatttaacactgtcacaaaaatgagaagttattattttttaagtgatcacatagttcataccactagtaactagaaaagatatttattcacatgatatttacaaggctcttcagaagggaacagtcagcattttaaattactagattttagcatacttaacaaggtttgaacagattctacccctattttcctccctttttagcgtcttctttccttaaagataaaagaaaactcaaatttgtttacattaggctttcttagcatataaatatatttccaaaataaattacatgttgtgtaaactttctcca

SEQ ID NO: 307144 - DNA, 268 bp, Homo sapiens
gacacgaacaactatcttacaaagcacaggaaaggtaattaaaatattttactcattcattggagtgagagagagagagagagagtgcgtttaatctgtggttatagaattggttaaactttgcttttaggtggaagtttcaagttttatctctttgaaagctcagtaataatgtagatttccagatggccatttttaccattccattcttgaatatggttgttagacatcagagatgctgatgaaaaagtaggaatcaaaatgcaag

SEQ ID NO: 307145 - DNA, 633 bp, Homo sapiens
tatgggcctgatgccaagacttaaatgcacctggaaatgctaattaattggtagatatcagtagatatactcctagagaagcagggctggaaacggaacaattacatttgcaggagagtattacttgacttcttatattgccttctgccattttcctggttaatttctaaagactcttcttactgctttggtaaataaattattcttagaccaatgatgctcagagtgtgcagtaattatccctaacaaatgtaacaaacgagttttgaattttgttctattgtgttgatgttgtcatgttttgtttcttttgcaagcaatagaatctttcttggcccaatgttcaaataacctttttcttatttgagcacatataaacacacaatcaataaaatttcccaagaaggaacaacataaatattttaaaaatatatcatagatactttacataaaatgtaatacctatgggactatttaaaacttattagttatttgattagattttcatttatttatgtggcaaattgaaattaaggaaactaagcatttgaattgagtgtaggaatattccctttcttcctttttttttttttttttaccatttatattgtcaaggtgaatccaagataatga

SEQ ID NO: 307146 - DNA, 883 bp, Homo sapiens
ctcgggagtaggtcataccacatacatgtatttgcattttatatttactattcaaatttatcacaaggcttgtctgatgcatttaatgatccacaaaattctccttgtgtttcaggatagaataaataagtcattcatattaaagagtataattactgtgattttaatgtgagctacacctttgtatttttacttttcactttattctctatcggtgattgtcagcatgcacagcttgccctcattacacagcggcacacactctcccctcgcacttgactctccgagggctaggagtttgtcaccctcttcagttcctgatctcttgtcctccgtcctggctgcgctcattcctcccacttcagtgctctatgagctgtgtgcccacacctgatggaagtgaatgctgaacctccccagatgccagcactctgtgttaaactgaagggctaggccatggttggtgaccatgttaggaaagaagacttcgtgcaccagtgtccccagcttccggtgagagtgaagtgctccagagagactagttgggccgtcatgcaacaaaggttgcctcgttctttatctgtttatgcagtgaattgaacagtctgattctttatggcttgccaagtgaagccttaagtgtatttaatattttcccaaattgtggacccatagccaccagcaaggctacttacataaagatttctttaaaatggcataaaatgagttctcttgcaacttttactagaagttttattcaaaatgatttattggaaggactcaaaattactcagtttttatctaatttgcagaactaaaataaaatagggaaggatgtctcttgtaattcttgacctccctgtcccccagtgtcttcacatgt

SEQ ID NO: 307147 - DNA, 731 bp, Homo sapiens
gttagagagggagtggagaacgcataagcaagctggtttgaccagaaacagaactgcctgtgacagattaagagacaagcaaggcttggaatctgagagcaagcaaagagagtggaaatttacagctgccctatgaggcaacctctattaaatggacgataaaggctacttcatctaaagtgctttgagctcaagaaagagctgtcttcagcacctcaccatgtgtctacattttgttgcttagaaaagcctaggcatttctgtaacatttgcattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggtaagagctaaaacagtaacattatgattaaagtacatgcatcgcaatgccaaaaaccaatgtaaaagcttaatgaagaattcaaaatatggtctgtgatgtgcacatagaccctctataaatagatttaagttgatttcaggttttatgcaactgattattatttagtctgttgtgatgaactttaggttcactctctagagactctgaccacaccggatccctctagactacacagcttaaagatctaaaaggttatactggtgtgtaatgttacatttacatgaaaggtaaaaagtttttatttaaagattgac

SEQ ID NO: 307148 - DNA, 3564 bp, Homo sapiens
ccgcagtggcgcccgagcgcgccgcctcccgattgactgctagcgctctcggcttgtctcgcgcactgtagctgagccaatggagttactcgtagtcgagaggccggcatcactggagtggtggcgcagctgtttcctccggatatccatcaaatattgagaagaaagaatatcaggagcaaagtgttctaagttgctgctcagaacgtaaagatgcgaaccccaaatcagtggtttgttcattcttcatgcaagagcaatgcactaaaggagagaagcaagctgtggtgatcagtgactttggtgaaagctaagaaggttcaaacaaatttgcaaatgatatacaacttctaagcattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggcttcagaagaagtgtctaaatcactgcaagcaatgaaagaaattctgtgtggtacaaacgagaaagaacccccaacagaagcagtggctcagctagcacaagaactctacagcagtggcctgctggtgacactgatagctgacctgcagctgatagactttgagggaaaaaaagatgtgacccagatatttaacaacatcttgagaagacagataggcactcggagtcctactgtggagtatattagtgctcatcctcatatcctgtttatgctcctcaaaggatatgaagccccacagattgccttacgttgtgggattatgctgagagaatgtattcgacatgaaccacttgccaaaatcatcctcttttctaatcaattcagagatttctttaagtacgtggagttgtcaacatttgatattgcttcagatgcctttgctactttcaaggatttactaaccagacataaagtgttggtagcagacttcttagaacaaaattacgacactatttttgaagactatgagaaattgcttcagtctgagaattatgttactaagagacagtctttaaagctgctaggggagctgatcctggaccgtcacaactttgccatcatgacaaagtatatcagcaagccggagaacctgaaactcatgatgaacctccttcgggataaaagtcccaacatccagtttgaagcctttcatgtttttaaggtgtttgtggccagtcctcacaaaacacagcctattgtggagatcctgttaaaaaatcagcccaaactcattgagtttctgagcagcttccaaaaagaaaggacggatgatgagcagttcgctgacgagaagaactacttgattaaacagatccgagacttgaagaaaacggccccttgaagagctccccggcccctgtcacagtcagtcgtctcatttgtccagtttgtacagtgtgtcatttcagaaagtcatcattcttgggaagactttggaggtgcctattttttctgctgtaattgttctgggtagatggagtataaacatttgaatggaaaaaaattaacctagaataatatattcattttagtcaagtctgtgattatttatgtgaaatgagaaccattgtatcagatgttgataaaagcaattttaacttgcagatgtgagcccctgggcacaatgagccgctaaatgggagctcaattgacaggcatcaccaagtcttcaaggaggactgagttctcaggggagaactgggaatggggccagggtgcaaaaatgctttgcccatctgtaggtagacacacagatcgctcagggcactgagagatcccagaaggtaacgttaatgttttcagtcattgtgtgtcctttgttgctgccaatgtctttggactgtaatcagtgcatccacacctcccaggatccagtgctccctctcagctcagtctcccctctctccctgtcctgcattccatcccagctcctcagcatggcctcagtgggcgcacccatgcctcccgcagtccaggtgagcaggggagcaactgagcaggaagaggatggatcaacaagggtcacggggaataggggacccacggggtgtgacctgcttgctagagaactgtgaacatgtggctctggatagagtgactgctgctccatattagcttccagagggtgagtgagggacagaatatttccttcataatggtcatgggtgaatgctttctgctgtaagtgtcttttagagtaggaatcagcatagtgggatgcccagcaggcacaaaccatgggtccagggagtctcagcggggaacttctatcagtatcaataaccattggaaggagaaatgattcatgtgtgaaaaaattctcagatccatcaataaatttttttcagagccattgtatcagatgttgataaaagcaatttttttctaataagctgtcattctataattgcccatcacagtctttagtgaacacatagaaagcctatacagttttggtcctgaatagtctcttgtgactaggatgattgaggtgttaattcctcttccttataaaaaggcttggaatcaaaaatattttaaaaggccgtggtttcgtttcagacatcaaccatctaaaacgggattttaaagcgatattttacaagaatgaaaggcacaattgttgatctgtattttttacacttcagtttctaaatcatgaatcgttgccttccacaggaaccctcccttatacattacttgagtgttgtgtagtttttcttcagccaggtatttctctgcctagagaggggaagagaaatgtgttctccaggactgatcccctttgtagattttgtacctgaagagttacctggcagggcaccacccttggctaggcccaggtgtatgtttctttcttgcctggcatggaccccgaggcaggtgatgtggggcctggcgcacctccccgctttggcagctgtggcctccctggccagtgcccttgcaggaggccggccggcagcctgatgacccgcactctttagtcactgacgtcagattatttttataacgttccctgacagttcagagtcccttcgaattgcacttttctggtttcgcttatttaattaaaagagatgagtgtaagtataaaaaatgaaggtgaaataaccattggaattgtatttggttacttaatactgttccacaacatcttgggacgtctgttttcctttggagagtgaggccttgttattattcttttctgataaagaaaacattttatttcctttgggcttgcattagctctttcctagcaacccattatcccagctcagtacctttcaaacagaaaactagagtctggggttttgttgtgatctgaatttgtaagttattaatgtgaaagggggagcaggaagctccccctttgcacaaagggggatttgtttgcacaaagttcactgtaaatactgtgagaattgaattctgaaaaggtcatatttagtgatttcaaaagcacacatttaaatgaagactgactaaataaaaggtaccacaca

SEQ ID NO: 307149 - DNA, 3605 bp, Homo sapiens
gttagagagggagtggagaacgcataagcaagctggtttgaccagaaacagaactgcctgtgacagattaagagacaagcaaggcttggaatctgagagcaagcaaagagagtggaaatttacagctgccctatgtgagtgttcaagtgatcattttctggtaacgttttccagtggtaactgttactcttcaaaaagagggacagaaagtcaagacctaattgtggaaactcttttctctgccacgcttggtaataggaggcaacctctattaaatggacgataaaggctacttcatctaaagtgctttgagctcaagaaagagctgtcttcagcacctcaccatgtgtctacattttgttgcttagaaaagcctaggcatttctgtaacatttgcattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggcttcagaagaagtgtctaaatcactgcaagcaatgaaagaaattctgtgtggtacaaacgagaaagaacccccaacagaagcagtggctcagctagcacaagaactctacagcagtggcctgctggtgacactgatagctgacctgcagctgatagactttgagggaaaaaaagatgtgacccagatatttaacaacatcttgagaagacagataggcactcggagtcctactgtggagtatattagtgctcatcctcatatcctgtttatgctcctcaaaggatatgaagccccacagattgccttacgttgtgggattatgctgagagaatgtattcgacatgaaccacttgccaaaatcatcctcttttctaatcaattcagagatttctttaagtacgtggagttgtcaacatttgatattgcttcagatgcctttgctactttcaaggatttactaaccagacataaagtgttggtagcagacttcttagaacaaaattacgacactatttttgaagactatgagaaattgcttcagtctgagaattatgttactaagagacagtctttaaagctgctaggggagctgatcctggaccgtcacaactttgccatcatgacaaagtatatcagcaagccggagaacctgaaactcatgatgaacctccttcgggataaaagtcccaacatccagtttgaagcctttcatgtttttaaggtgtttgtggccagtcctcacaaaacacagcctattgtggagatcctgttaaaaaatcagcccaaactcattgagtttctgagcagcttccaaaaagaaaggacggatgatgagcagttcgctgacgagaagaactacttgattaaacagatccgagacttgaagaaaacggccccttgaagagctccccggcccctgtcacagtcagtcgtctcatttgtccagtttgtacagtgtgtcatttcagaaagtcatcattcttgggaagactttggaggtgcctattttttctgctgtaattgttctgggtagatggagtataaacatttgaatggaaaaaaattaacctagaataatatattcattttagtcaagtctgtgattatttatgtgaaatgagaaccattgtatcagatgttgataaaagcaattttaacttgcagatgtgagcccctgggcacaatgagccgctaaatgggagctcaattgacaggcatcaccaagtcttcaaggaggactgagttctcaggggagaactgggaatggggccagggtgcaaaaatgctttgcccatctgtaggtagacacacagatcgctcagggcactgagagatcccagaaggtaacgttaatgttttcagtcattgtgtgtcctttgttgctgccaatgtctttggactgtaatcagtgcatccacacctcccaggatccagtgctccctctcagctcagtctcccctctctccctgtcctgcattccatcccagctcctcagcatggcctcagtgggcgcacccatgcctcccgcagtccaggtgagcaggggagcaactgagcaggaagaggatggatcaacaagggtcacggggaataggggacccacggggtgtgacctgcttgctagagaactgtgaacatgtggctctggatagagtgactgctgctccatattagcttccagagggtgagtgagggacagaatatttccttcataatggtcatgggtgaatgctttctgctgtaagtgtcttttagagtaggaatcagcatagtgggatgcccagcaggcacaaaccatgggtccagggagtctcagcggggaacttctatcagtatcaataaccattggaaggagaaatgattcatgtgtgaaaaaattctcagatccatcaataaatttttttcagagccattgtatcagatgttgataaaagcaatttttttctaataagctgtcattctataattgcccatcacagtctttagtgaacacatagaaagcctatacagttttggtcctgaatagtctcttgtgactaggatgattgaggtgttaattcctcttccttataaaaaggcttggaatcaaaaatattttaaaaggccgtggtttcgtttcagacatcaaccatctaaaacgggattttaaagcgatattttacaagaatgaaaggcacaattgttgatctgtattttttacacttcagtttctaaatcatgaatcgttgccttccacaggaaccctcccttatacattacttgagtgttgtgtagtttttcttcagccaggtatttctctgcctagagaggggaagagaaatgtgttctccaggactgatcccctttgtagattttgtacctgaagagttacctggcagggcaccacccttggctaggcccaggtgtatgtttctttcttgcctggcatggaccccgaggcaggtgatgtggggcctggcgcacctccccgctttggcagctgtggcctccctggccagtgcccttgcaggaggccggccggcagcctgatgacccgcactctttagtcactgacgtcagattatttttataacgttccctgacagttcagagtcccttcgaattgcacttttctggtttcgcttatttaattaaaagagatgagtgtaagtataaaaaatgaaggtgaaataaccattggaattgtatttggttacttaatactgttccacaacatcttgggacgtctgttttcctttggagagtgaggccttgttattattcttttctgataaagaaaacattttatttcctttgggcttgcattagctctttcctagcaacccattatcccagctcagtacctttcaaacagaaaactagagtctggggttttgttgtgatctgaatttgtaagttattaatgtgaaagggggagcaggaagctccccctttgcacaaagggggatttgtttgcacaaagttcactgtaaatactgtgagaattgaattctgaaaaggtcatatttagtgatttcaaaagcacacatttaaatgaagactgactaaataaaaggtaccacaca

SEQ ID NO: 307150 - DNA, 3510 bp, Homo sapiens
ccgcagtggcgcccgagcgcgccgcctcccgattgactgctagcgctctcggcttgtctcgcgcactgtagctgagccaatggagttactcgtagtcgagaggccggcatcactggagtggtggcgcagctgtttcctccggatatccatcaaatattgagaagaaagaatatcaggagcaaagtgttctaagttgctgctcagaacgtaaagatgcgaaccccaaatcagtggtttgttcattcttcatgcaagagcaatgcactaaaggagagaagcaagctgtggtgatcagtgactttggtgaaagctaagaaggttcaaacaaatttgcaaatgatatacaacttctaagcattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggcttcagaagaagtgtctaaatcactgcaagcaatgaaagaaattctgtgtggtacaaacgagaaagaacccccaacagaagcagtggctcagctagcacaagaactctacagcagtggcctgctggtgacactgatagctgacctgcagctgatagactttgagggaaaaaaagatgtgacccagatatttaacaacatcttgagaagacagataggcactcggagtcctactgtggagtatattagtgctcatcctcatatcctgtttatgctcctcaaaggatatgaagccccacagattgccttacgttgtgggattatgctgagagaatgtattcgacatgaaccacttgccaaaatcatcctcttttctaatcaattcagagatttctttaagtacgtggagttgtcaacatttgatattgcttcagatgcctttgctactttcaaggatttactaaccagacataaagtgttggtagcagacttcttagaacaaaattacgacactatttttgaagactatgagaaattgcttcagtctgagaattatgttactaagagacagtctttaaagctgctaggggagctgatcctggaccgtcacaactttgccatcatgacaaagtatatcagcaagccggagaacctgaaactcatgatgaacctccttcgggataaaagtcccaacatccagtttgaagcctttcatgtttttaaggtgtttgtggccagtcctcacaaaacacagcctattgtggagatcctgttaaaaaatcagcccaaactcattgagtttctgagcagcttccaaaaagaaaggacggatgatgagcagttcgctgacgagaagaactacttgattaaacagatccgagacttgaagaaaacggccccttgaagagctccccggcccctgtcacagtcagtcgtctcatttgtccagtttgtacagtgtgtcatttcagaaagtcatcattcttgggaagactttggaggtgcctattttttctgctgtaattgttctgggtagatggagtataaacatttgaatggaaaaaaattaacctagaataatatattcattttagtcaagtctgtgattatttatgtgaaatgagaaccattgtatcagatgttgataaaagcaattttaacttgcagatgtgagcccctgggcacaatgagccgctaaatgggagctcaattgacaggcatcaccaagtcttcaaggaggactgagttctcaggggagaactgggaatggggccagggtgcaaaaatgctttgcccatctgtaggtagacacacagatcgctcagggcactgagagatcccagaaggtaacgttaatgttttcagtcattgtgtgtcctttgttgctgccaatgtctttggactgtaatcagtgcatccacacctcccaggatccagtgctccctctcagctcagtctcccctctctccctgtcctgcattccatcccagctcctcagcatggcctcagtgggcgcacccatgcctcccgcagtccaggtgagcaggggagcaactgagcaggaagaggatggatcaacaagggtcacggggaataggggacccacggggtgtgacctgcttgctagagaactgtgaacatgtggctctggatagagtgactgctgctccatattagcttccagagggtgagtgagggacagaatatttccttcataatggtcatgggtgaatgctttctgctgtaagtgtcttttagagtaggaatcagcatagtgggatgcccagcaggcacaaaccatgggtccagggagtctcagcggggaacttctatcagtatcaataaccattggaaggagaaatgattcatgtgtgaaaaaattctcagatccatcaataaatttttttcagagccattgtatcagatgttgattagtgaacacatagaaagcctatacagttttggtcctgaatagtctcttgtgactaggatgattgaggtgttaattcctcttccttataaaaaggcttggaatcaaaaatattttaaaaggccgtggtttcgtttcagacatcaaccatctaaaacgggattttaaagcgatattttacaagaatgaaaggcacaattgttgatctgtattttttacacttcagtttctaaatcatgaatcgttgccttccacaggaaccctcccttatacattacttgagtgttgtgtagtttttcttcagccaggtatttctctgcctagagaggggaagagaaatgtgttctccaggactgatcccctttgtagattttgtacctgaagagttacctggcagggcaccacccttggctaggcccaggtgtatgtttctttcttgcctggcatggaccccgaggcaggtgatgtggggcctggcgcacctccccgctttggcagctgtggcctccctggccagtgcccttgcaggaggccggccggcagcctgatgacccgcactctttagtcactgacgtcagattatttttataacgttccctgacagttcagagtcccttcgaattgcacttttctggtttcgcttatttaattaaaagagatgagtgtaagtataaaaaatgaaggtgaaataaccattggaattgtatttggttacttaatactgttccacaacatcttgggacgtctgttttcctttggagagtgaggccttgttattattcttttctgataaagaaaacattttatttcctttgggcttgcattagctctttcctagcaacccattatcccagctcagtacctttcaaacagaaaactagagtctggggttttgttgtgatctgaatttgtaagttattaatgtgaaagggggagcaggaagctccccctttgcacaaagggggatttgtttgcacaaagttcactgtaaatactgtgagaattgaattctgaaaaggtcatatttagtgatttcaaaagcacacatttaaatgaagactgactaaataaaaggtaccacaca

SEQ ID NO: 307151 - DNA, 1597 bp, Homo sapiens
gttagagagggagtggagaacgcataagcaagctggtttgaccagaaacagaactgcctgtgacagattaagagacaagcaaggcttggaatctgagagcaagcaaagagagtggaaatttacagctgccctatgtgagtgttcaagtgatcattttctggtaacgttttccagtggtaactgttactcttcaaaaagagggacagaaagtcaagacctaattgtggaaactcttttctctgccacgcttggtaataggaggcaacctctattaaatggacgataaaggctacttcatctaaagtgctttgagctcaagaaagagctgtcttcagcacctcaccatgtgtctacattttgttgcttagaaaagcctaggcatttctgtaacatttgcattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggcttcagaagaagtgtctaaatcactgcaagcaatgaaagaaattctgtgtggtacaaacgagaaagaacccccaacagaagcagtggctcagctagcacaagaactctacagcagtggcctgctggtgacactgatagctgacctgcagctgatagactttgagggaaaaaaagatgtgacccagatatttaacaacatcttgagaagacagataggcactcggagtcctactgtggagtatattagtgctcatcctcatatcctgtttatgctcctcaaaggatatgaagccccacagattgccttacgttgtgggattatgctgagagaatgtattcgacatgaaccacttgccaaaatcatcctcttttctaatcaattcagagatttctttaagtacgtggagttgtcaacatttgatattgcttcagatgcctttgctactttcaaggatttactaaccagacataaagtgttggtagcagacttcttagaacaaaattacgacactatttttgaagactatgagaaattgcttcagtctgagaattatgttactaagagacagtctttaaagctgctaggggagctgatcctggaccgtcacaactttgccatcatgacaaagtatatcagcaagccggagaacctgaaactcatgatgaacctccttcgggataaaagtcccaacatccagtttgaagcctttcatgtttttaaggtgtttgtggccagtcctcacaaaacacagcctattgtggagatcctgttaaaaaatcagcccaaactcattgagtttctgagcagcttccaaaaagaaaggacggatgatgagcagttcgctgacgagaagaactacttgattaaacagatccgagacttgaagaaaacggccccttgaagagctccccggcccctgtcacagtcagtcgtctcatttgtccagtttgtacagtgtgtcatttcagaaagtcatcattcttgggaagactttggaggtgcctattttttctgctgtaattgttctgggtagatggagtataaacatttgaatgga

SEQ ID NO: 307152 - DNA, 845 bp, Homo sapiens
gaacagtctgattctttatggcttgccaagtgaagccttaagtgtatttaatattttcccaaattgtggacccatagccaccagcaaggctacttacataaagatttctttaaaatggcataaaatgagttctcttgcaacttttactagaagttttattcaaaatgatttattggaaggactcaaaattactcagtttttatctaatttgcagaactaaaataaaatagggaaggatgtctcttgtaattcttgacctccctgtcccccagtgtcttcacatgtaaagaaggatggtaaaatggccagaagttgggaatttgctcctgaaaaagaaagcaagccagcctaatacggagaatccactgctgcttttacactctaatgtgtattttcttttcattagatttttgaagactatgagaaattgcttcagtctgagaattatgttactaagagacagtctttaaaggtaatatcaaatttctttaagtcagtgtccccgtaagtttatatctcattagcaaatgacgggtctattagtatatgagtaaacacagaaaaattaaaatatcctttttttaaataacttgagaagtatttactatattttatgttatgactgtattttatagcaaaataatgtaagtgtcctgtcctgcttttggaagtaacaatataagtacatgataagtaaaatttagaatatttctgctgaggccaggcatcttggcttacgcctgtaatcccagcactttgggaggccgaagtgggcggatcacctgaggtcaggagttcgagaccagcctggccaacatggcaaaaccccatctctactaaaaata

SEQ ID NO: 307153 - DNA, 192 bp, Homo sapiens
atatgaagccccacagattgccttacgttgtgggattatgctgagagaatgtattcgacatgaaccacttgccaaaatcatcctcttttctaatcaattcagagatttctttaagtacgtggagttgtcaacatttgatattgcttcagatgcctttgctactttcaaggtaattttttttttccaactcag

SEQ ID NO: 307154 - DNA, 4397 bp, Homo sapiens
tgtttctgtgcagtattttgaggtctttttcaacctattgtatttaatctgttattccttataacactgacaatcggtatgattgatccggattttgcagataagcctaaattaccagaaaactacacagatgaaacctggcaaaaactgaaagaagcagtggaagctattcagaatagtacttcaattaagtacaatttagaagaactctaccaggctgtagaaaatctctgttcttacaagatttctgcaaacttgtacaaacagctgagacagatctgcgaagatcacatcaaagcacagattcatcaattcagagaggattcattggatagcgttctttttttaaagaagattgatagatgctggcaaaaccattgcagacaaatgatcatgatcaggagcatttttttgtttctggatagaacttacgttcttcagaattcaatgctaccctccatttgggacatgggactggagttatttagggctcatattataagtgatcagaaagtgcagaataagacaattgatggcattcttctcttgattgagagggaaaggaatggtgaagcaattgatagaagtttacttcgaagccttttaagcatgctgtctgatttgcaaatttatcaagattcttttgaacaacgatttttggaagaaactaaccggctctatgcagctgaaggccaaaaattaatgcaagaaagagaggttcctgaatatctacatcatgttaacaaacgtctagaagaagaagcagacagacttattacttacttagatcagaccacccagaagtcattaattgctactgtagaaaaacaacttctaggtgaacacttaacagcaattcttcagaaaggtttaaataacctccttgatgaaaaccgaattcaagatttgtctcttctgtatcagctcttcagtagagttcgaggtggagttcaggttcttttgcagcagtggatcgaatatatcaaggcatttggcagcactattgtaattaatcctgaaaaagataaaaccatggttcaagaattgctggattttaaagataaggttgaccatataattgatatctgctttctgaagaatgagaaatttatcaatgccatgaaagaagcatttgaaacgttcattaacaaaagaccaaataaaccagctgaacttatagctaagtatgtagattcaaaacttcgtgcaggcaacaaagaagctacagatgaagaacttgagaaaatgttggataaaattatgatcatatttagatttatctatggcaaggatgtttttgaggccttctataagaaagatttagccaagcgcctgttagtcggaaagagtgcatctgtagatgctgaaaaatcaatgctgtccaaacttaaacatgaatgcggagctgctttcaccagcaaacttgaaggaatgtttaaagacatggaactttctaaagacatcatgattcagttcaaacagtatatgcagaatcagaatgttccgggaaatattgagttaactgtgaatatcctgacaatgggctattggccgacatatgtgcctatggaagttcatttaccaccagagatggtaaaacttcaggagattttcaagacattttacctaggcaaacatagtggcaggaaacttcagtggcagtcaaccctaggacactgtgtgttaaaagcagaatttaaagagggtaaaaaggaactccaggtctctctttttcaaacactggtgctgctaatgtttaatgagggagaggagttcagtttagaagagatcaagcaggcaactggaatagaggatggagagttaaggagaacactgcagtcattagcctgtggcaaagctagagttctggcgaaaaatccaaagggcaaagacattgaagatggtgacaagttcatttgtaatgatgatttcaaacataaacttttcaggataaagatcaatcaaatccagatgaaagaaacggttgaagaacaagcaagcactacagaaagagtatttcaagacagacagtatcaaattgatgctgcaattgttcgaattatgaagatgagaaagacacttagccacaatctccttgtttcagaagtgtacaaccagttgaaatttccagtaaagcctgctgatcttaagaagagaatagaatctttaattgaccgggactacatggaaagagataaagaaaatccaaaccagtacaactatattgcatagaatgttggccttgcagcatttggtgtcatatgcagtagccagtggataaactaacctgttgattcaatattatttgactccttttttactaccgatgaccaaatgaagcagtgtaattaatggaaatagttgagtggactttttctcagtggttaacatgcccattttaaagagtaatacttacctttaagaagaatgttgttgaactctttgcatgttatttagtatgatgtgcagaaaacacttaagaacgtacctggtcttcatgaattcctctttggaactgggaaagagatccctgtggctattaaaaaggggggagggttcttacacaccattaattatgaagcaaaaggtttatttgcttaaaatgtcatttaaagatacttaaactgcatgcaaactttatttactgtacagagttctggatgtatttatcaaatagaaaaaccacccttgacttggttgttcacccgttttgtgatttcccttgaaaagagaaatgaattgtcatagctattgatattttactaggtgatgttctgttacactgaaagggatgttttttaaaaaaaattatttggaaacaagttttcaagtagggggacagttgcttacataatatcttgtatattcacatcctaaaaattttcatttatgagtatgggatgtgtgtatatggcttagccccaagttaactgtgctgattaacaagtacttataaaaatagctaaagtagaaaattaatgatcagttgtactagaggaacatcatagaagagaaaaatccaactctttatattaaaaatgaatacaataagaaaattgcaaaagagaccaaaatgaacgtgttttgtaaattgttacaggagcaaaaactttgcaactagttttcaacatactttagactttaaatgttgtttggacagttttgtcttcaacttggaccaattgtagattgttacaggcttcctaggatttagcattcctattttctctaccaaagttttttttagaagcatcccaactcttctctttgttgataaataagcctttcctgtcatcttcattttaacttgctaaaaccctagatacaaaggtcctccctcatttttcccacagagcccctgtttgggaatttgagattctgtgtcatgctggttttcctttcagaattgcttgaaatcgagttctcttagccactggacacctagttttcaggagaatgtcccaagattgtttatatatacaaaatggcaaaagtactgtttttcgaattgataattcaagcaaaggcttctctttactgtcactgatttttttttgtttttattttgtttccttgtttctatttccttgaagctttgaagggaggagaagcagaaaattttggtttatgtttgttaaaaatcagaactacttaatgctttttgccacagcatatttccttgcctgttggagccgttaggaagattacctatgtcctaatcttcaacctgagaagatttttgactcttgtgtctactgttgattgtttgcttgagttctcaaagacctgtggccaggtattttaaaaagtcgtctatttctttctagttgcatcaacttgcacactggtgtctaactatatgtggtattcggaacttgtaattcttattgagcagccattgcctatattttctcagctcctcactgatttctttatatgagctcagctgacaagcaaatgcagctattttgtttaccctctcttcataccggaccatcaacaacagtgttctaactcatccctgatggtctgtgagatgtagactattacacaagattcaagttactcgtaagcaacttttagatagagttggtcctgttaggaggagactcttgatgtcaccttcagtatcttgaaagcgggtcccctccccgaggctcttaattctttgaaaacttgatgctgtttcagctgaaaaattagcaagactgttaaaaaaaaaaagttgaggggagctgtttaagaaactgaaaagtaattgcaaactacattggataattgtgactttcagttgttgttctgtatcagttgaatttttgtgctcttttccctgtgtacgtggtggttctatttttctccaataaaacttttatttaccaaaagtttctagagaagat

SEQ ID NO: 307155 - DNA, 5142 bp, Homo sapiens
gagagatcgaaaagcaggggagggggacggcacggccgtttacctgtctgcctcctcattcgctctcccccctcgttctgctcactcctggtgtcagcctatccgccttcccaaaccctcccattcccccggtgtagccccccccttcactttccttctcgtcctctgtgtttctcctctcttctttcttcccttccccctctagcattgctaccttctctcctacacgcacgcaggcatataaacgtaggtttttgatgctcctctgcctgttgaccccgctattttcatgtttccaacaggtttttcttcccccagtccctcagctgctgctgctgctcaggaggtcagatctgccactgatggtaataccagcaccactccgcccacctctgccaagaagagaaagttaaacagcagcagcagtagcagcagtaacagtagtaacgagagagaagactttgattccacctcttcctcctcttccactcctcctttacaacccagggattcggcatccccttcaacctcgtccttctgcctgggggtttcagtggctgcttccagccacgtaccgatacagaagaagctgcgttttgaagacaccctggagtttgtagggtttgatgcgaagatggctgaggaatcctcctcctcctcctcctcatcttcaccaactgctgcaacatctcagcagcagcaacttaaaaataagagtatattaatctcttctgtggcttcggtgcatcatgcaaacggcctagccaaatcttctaccaccgtctctagctttgctaacagcaaacctggctctgctaagaagttagtgatcaagaactttaaagataagcctaaattaccagaaaactacacagatgaaacctggcaaaaactgaaagaagcagtggaagctattcagaatagtacttcaattaagtacaatttagaagaactctaccaggctgtagaaaatctctgttcttacaagatttctgcaaacttgtacaaacagctgagacagatctgcgaagatcacatcaaagcacagattcatcaattcagagaggattcattggatagcgttctttttttaaagaagattgatagatgctggcaaaaccattgcagacaaatgatcatgatcaggagcatttttttgtttctggatagaacttacgttcttcagaattcaatgctaccctccatttgggacatgggactggagttatttagggctcatattataagtgatcagaaagtgcagaataagacaattgatggcattcttctcttgattgagagggaaaggaatggtgaagcaattgatagaagtttacttcgaagccttttaagcatgctgtctgatttgcaaatttatcaagattcttttgaacaacgatttttggaagaaactaaccggctctatgcagctgaaggccaaaaattaatgcaagaaagagaggttcctgaatatctacatcatgttaacaaacgtctagaagaagaagcagacagacttattacttacttagatcagaccacccagaagtcattaattgctactgtagaaaaacaacttctaggtgaacacttaacagcaattcttcagaaaggtttaaataacctccttgatgaaaaccgaattcaagatttgtctcttctgtatcagctcttcagtagagttcgaggtggagttcaggttcttttgcagcagtggatcgaatatatcaaggcatttggcagcactattgtaattaatcctgaaaaagataaaaccatggttcaagaattgctggattttaaagataaggttgaccatataattgatatctgctttctgaagaatgagaaatttatcaatgccatgaaagaagcatttgaaacgttcattaacaaaagaccaaataaaccagctgaacttatagctaagtatgtagattcaaaacttcgtgcaggcaacaaagaagctacagatgaagaacttgagaaaatgttggataaaattatgatcatatttagatttatctatggcaaggatgtttttgaggccttctataagaaagatttagccaagcgcctgttagtcggaaagagtgcatctgtagatgctgaaaaatcaatgctgtccaaacttaaacatgaatgcggagctgctttcaccagcaaacttgaaggaatgtttaaagacatggaactttctaaagacatcatgattcagttcaaacagtatatgcagaatcagaatgttccgggaaatattgagttaactgtgaatatcctgacaatgggctattggccgacatatgtgcctatggaagttcatttaccaccagagatggtaaaacttcaggagattttcaagacattttacctaggcaaacatagtggcaggaaacttcagtggcagtcaaccctaggacactgtgtgttaaaagcagaatttaaagagggtaaaaaggaactccaggtctctctttttcaaacactggtgctgctaatgtttaatgagggagaggagttcagtttagaagagatcaagcaggcaactggaatagaggatggagagttaaggagaacactgcagtcattagcctgtggcaaagctagagttctggcgaaaaatccaaagggcaaagacattgaagatggtgacaagttcatttgtaatgatgatttcaaacataaacttttcaggataaagatcaatcaaatccagatgaaagaaacggttgaagaacaagcaagcactacagaaagagtatttcaagacagacagtatcaaattgatgctgcaattgttcgaattatgaagatgagaaagacacttagccacaatctccttgtttcagaagtgtacaaccagttgaaatttccagtaaagcctgctgatcttaagaagagaatagaatctttaattgaccgggactacatggaaagagataaagaaaatccaaaccagtacaactatattgcatagaatgttggccttgcagcatttggtgtcatatgcagtagccagtggataaactaacctgttgattcaatattatttgactccttttttactaccgatgaccaaatgaagcagtgtaattaatggaaatagttgagtggactttttctcagtggttaacatgcccattttaaagagtaatacttacctttaagaagaatgttgttgaactctttgcatgttatttagtatgatgtgcagaaaacacttaagaacgtacctggtcttcatgaattcctctttggaactgggaaagagatccctgtggctattaaaaaggggggagggttcttacacaccattaattatgaagcaaaaggtttatttgcttaaaatgtcatttaaagatacttaaactgcatgcaaactttatttactgtacagagttctggatgtatttatcaaatagaaaaaccacccttgacttggttgttcacccgttttgtgatttcccttgaaaagagaaatgaattgtcatagctattgatattttactaggtgatgttctgttacactgaaagggatgttttttaaaaaaaattatttggaaacaagttttcaagtagggggacagttgcttacataatatcttgtatattcacatcctaaaaattttcatttatgagtatgggatgtgtgtatatggcttagccccaagttaactgtgctgattaacaagtacttataaaaatagctaaagtagaaaattaatgatcagttgtactagaggaacatcatagaagagaaaaatccaactctttatattaaaaatgaatacaataagaaaattgcaaaagagaccaaaatgaacgtgttttgtaaattgttacaggagcaaaaactttgcaactagttttcaacatactttagactttaaatgttgtttggacagttttgtcttcaacttggaccaattgtagattgttacaggcttcctaggatttagcattcctattttctctaccaaagttttttttagaagcatcccaactcttctctttgttgataaataagcctttcctgtcatcttcattttaacttgctaaaaccctagatacaaaggtcctccctcatttttcccacagagcccctgtttgggaatttgagattctgtgtcatgctggttttcctttcagaattgcttgaaatcgagttctcttagccactggacacctagttttcaggagaatgtcccaagattgtttatatatacaaaatggcaaaagtactgtttttcgaattgataattcaagcaaaggcttctctttactgtcactgatttttttttgtttttattttgtttccttgtttctatttccttgaagctttgaagggaggagaagcagaaaattttggtttatgtttgttaaaaatcagaactacttaatgctttttgccacagcatatttccttgcctgttggagccgttaggaagattacctatgtcctaatcttcaacctgagaagatttttgactcttgtgtctactgttgattgtttgcttgagttctcaaagacctgtggccaggtattttaaaaagtcgtctatttctttctagttgcatcaacttgcacactggtgtctaactatatgtggtattcggaacttgtaattcttattgagcagccattgcctatattttctcagctcctcactgatttctttatatgagctcagctgacaagcaaatgcagctattttgtttaccctctcttcataccggaccatcaacaacagtgttctaactcatccctgatggtctgtgagatgtagactattacacaagattcaagttactcgtaagcaacttttagatagagttggtcctgttaggaggagactcttgatgtcaccttcagtatcttgaaagcgggtcccctccccgaggctcttaattctttgaaaacttgatgctgtttcagctgaaaaattagcaagactgttaaaaaaaaaaagttgaggggagctgtttaagaaactgaaaagtaattgcaaactacattggataattgtgactttcagttgttgttctgtatcagttgaatttttgtgctcttttccctgtgtacgtggtggttctatttttctccaataaaacttttatttaccaaaagtttctagagaagat

SEQ ID NO: 307156 - DNA, 4915 bp, Homo sapiens
cccccactcaagtcctgcggacctgggggcttcgggatctgggcgctatgaaaagtgtctgcccagtcacttccggtttttcttcccccagtccctcagctgctgctgctgctcaggaggtcagatctgccactgatggtaataccagcaccactccgcccacctctgccaagaagagaaagttaaacagcagcagcagtagcagcagtaacagtagtaacgagagagaagactttgattccacctcttcctcctcttccactcctcctttacaacccagggattcggcatccccttcaacctcgtccttctgcctgggggtttcagtggctgcttccagccacgtaccgatacagaagaagctgcgttttgaagacaccctggagtttgtagggtttgatgcgaagatggctgaggaatcctcctcctcctcctcctcatcttcaccaactgctgcaacatctcagcagcagcaacttaaaaataagagtatattaatctcttctgtggcttcggtgcatcatgcaaacggcctagccaaatcttctaccaccgtctctagctttgctaacagcaaacctggctctgctaagaagttagtgatcaagaactttaaagataagcctaaattaccagaaaactacacagatgaaacctggcaaaaactgaaagaagcagtggaagctattcagaatagtacttcaattaagtacaatttagaagaactctaccaggctgtagaaaatctctgttcttacaagatttctgcaaacttgtacaaacagctgagacagatctgcgaagatcacatcaaagcacagattcatcaattcagagaggattcattggatagcgttctttttttaaagaagattgatagatgctggcaaaaccattgcagacaaatgatcatgatcaggagcatttttttgtttctggatagaacttacgttcttcagaattcaatgctaccctccatttgggacatgggactggagttatttagggctcatattataagtgatcagaaagtgcagaataagacaattgatggcattcttctcttgattgagagggaaaggaatggtgaagcaattgatagaagtttacttcgaagccttttaagcatgctgtctgatttgcaaatttatcaagattcttttgaacaacgatttttggaagaaactaaccggctctatgcagctgaaggccaaaaattaatgcaagaaagagaggttcctgaatatctacatcatgttaacaaacgtctagaagaagaagcagacagacttattacttacttagatcagaccacccagaagtcattaattgctactgtagaaaaacaacttctaggtgaacacttaacagcaattcttcagaaaggtttaaataacctccttgatgaaaaccgaattcaagatttgtctcttctgtatcagctcttcagtagagttcgaggtggagttcaggttcttttgcagcagtggatcgaatatatcaaggcatttggcagcactattgtaattaatcctgaaaaagataaaaccatggttcaagaattgctggattttaaagataaggttgaccatataattgatatctgctttctgaagaatgagaaatttatcaatgccatgaaagaagcatttgaaacgttcattaacaaaagaccaaataaaccagctgaacttatagctaagtatgtagattcaaaacttcgtgcaggcaacaaagaagctacagatgaagaacttgagaaaatgttggataaaattatgatcatatttagatttatctatggcaaggatgtttttgaggccttctataagaaagatttagccaagcgcctgttagtcggaaagagtgcatctgtagatgctgaaaaatcaatgctgtccaaacttaaacatgaatgcggagctgctttcaccagcaaacttgaaggaatgtttaaagacatggaactttctaaagacatcatgattcagttcaaacagtatatgcagaatcagaatgttccgggaaatattgagttaactgtgaatatcctgacaatgggctattggccgacatatgtgcctatggaagttcatttaccaccagagatggtaaaacttcaggagattttcaagacattttacctaggcaaacatagtggcaggaaacttcagtggcagtcaaccctaggacactgtgtgttaaaagcagaatttaaagagggtaaaaaggaactccaggtctctctttttcaaacactggtgctgctaatgtttaatgagggagaggagttcagtttagaagagatcaagcaggcaactggaatagaggatggagagttaaggagaacactgcagtcattagcctgtggcaaagctagagttctggcgaaaaatccaaagggcaaagacattgaagatggtgacaagttcatttgtaatgatgatttcaaacataaacttttcaggataaagatcaatcaaatccagatgaaagaaacggttgaagaacaagcaagcactacagaaagagtatttcaagacagacagtatcaaattgatgctgcaattgttcgaattatgaagatgagaaagacacttagccacaatctccttgtttcagaagtgtacaaccagttgaaatttccagtaaagcctgctgatcttaagaagagaatagaatctttaattgaccgggactacatggaaagagataaagaaaatccaaaccagtacaactatattgcatagaatgttggccttgcagcatttggtgtcatatgcagtagccagtggataaactaacctgttgattcaatattatttgactccttttttactaccgatgaccaaatgaagcagtgtaattaatggaaatagttgagtggactttttctcagtggttaacatgcccattttaaagagtaatacttacctttaagaagaatgttgttgaactctttgcatgttatttagtatgatgtgcagaaaacacttaagaacgtacctggtcttcatgaattcctctttggaactgggaaagagatccctgtggctattaaaaaggggggagggttcttacacaccattaattatgaagcaaaaggtttatttgcttaaaatgtcatttaaagatacttaaactgcatgcaaactttatttactgtacagagttctggatgtatttatcaaatagaaaaaccacccttgacttggttgttcacccgttttgtgatttcccttgaaaagagaaatgaattgtcatagctattgatattttactaggtgatgttctgttacactgaaagggatgttttttaaaaaaaattatttggaaacaagttttcaagtagggggacagttgcttacataatatcttgtatattcacatcctaaaaattttcatttatgagtatgggatgtgtgtatatggcttagccccaagttaactgtgctgattaacaagtacttataaaaatagctaaagtagaaaattaatgatcagttgtactagaggaacatcatagaagagaaaaatccaactctttatattaaaaatgaatacaataagaaaattgcaaaagagaccaaaatgaacgtgttttgtaaattgttacaggagcaaaaactttgcaactagttttcaacatactttagactttaaatgttgtttggacagttttgtcttcaacttggaccaattgtagattgttacaggcttcctaggatttagcattcctattttctctaccaaagttttttttagaagcatcccaactcttctctttgttgataaataagcctttcctgtcatcttcattttaacttgctaaaaccctagatacaaaggtcctccctcatttttcccacagagcccctgtttgggaatttgagattctgtgtcatgctggttttcctttcagaattgcttgaaatcgagttctcttagccactggacacctagttttcaggagaatgtcccaagattgtttatatatacaaaatggcaaaagtactgtttttcgaattgataattcaagcaaaggcttctctttactgtcactgatttttttttgtttttattttgtttccttgtttctatttccttgaagctttgaagggaggagaagcagaaaattttggtttatgtttgttaaaaatcagaactacttaatgctttttgccacagcatatttccttgcctgttggagccgttaggaagattacctatgtcctaatcttcaacctgagaagatttttgactcttgtgtctactgttgattgtttgcttgagttctcaaagacctgtggccaggtattttaaaaagtcgtctatttctttctagttgcatcaacttgcacactggtgtctaactatatgtggtattcggaacttgtaattcttattgagcagccattgcctatattttctcagctcctcactgatttctttatatgagctcagctgacaagcaaatgcagctattttgtttaccctctcttcataccggaccatcaacaacagtgttctaactcatccctgatggtctgtgagatgtagactattacacaagattcaagttactcgtaagcaacttttagatagagttggtcctgttaggaggagactcttgatgtcaccttcagtatcttgaaagcgggtcccctccccgaggctcttaattctttgaaaacttgatgctgtttcagctgaaaaattagcaagactgttaaaaaaaaaaagttgaggggagctgtttaagaaactgaaaagtaattgcaaactacattggataattgtgactttcagttgttgttctgtatcagttgaatttttgtgctcttttccctgtgtacgtggtggttctatttttctccaataaaacttttatttaccaaaagtttctagagaagat

SEQ ID NO: 307157 - DNA, 5312 bp, Homo sapiens
agcagttcagtttagaaactgccagtcttggtatagaacaacctaggcttatctgtttaagtcccataggtagtattattagagaataacccaggctttgggaactgtataactctgagatcgtttgaaattttcgttttgtttttcttttggctccaaccaggcctctgttgttagactaatggggtttcccctgcagagattggtcagccctgcagtctatcatcccggaaggtgttaaatacacatgaaagccagcctcggcgggcagaacctagcccgccgaaagggcgggcattgctaaagtgttttcaaaaggtcttcccaatcctctgctttagacagctcggaccttagatagaagaacacaacggatcctccagtgactgacgacccaaaggacggatgatgtcacagtcatctggatcaggagatgggaatgatgatgaggctactacctctaaagacggtggtttttcttcccccagtccctcagctgctgctgctgctcaggaggtcagatctgccactgatggtaataccagcaccactccgcccacctctgccaagaagagaaagttaaacagcagcagcagtagcagcagtaacagtagtaacgagagagaagactttgattccacctcttcctcctcttccactcctcctttacaacccagggattcggcatccccttcaacctcgtccttctgcctgggggtttcagtggctgcttccagccacgtaccgatacagaagaagctgcgttttgaagacaccctggagtttgtagggtttgatgcgaagatggctgaggaatcctcctcctcctcctcctcatcttcaccaactgctgcaacatctcagcagcagcaacttaaaaataagagtatattaatctcttctgtggcttcggtgcatcatgcaaacggcctagccaaatcttctaccaccgtctctagctttgctaacagcaaacctggctctgctaagaagttagtgatcaagaactttaaagataagcctaaattaccagaaaactacacagatgaaacctggcaaaaactgaaagaagcagtggaagctattcagaatagtacttcaattaagtacaatttagaagaactctaccaggctgtagaaaatctctgttcttacaagatttctgcaaacttgtacaaacagctgagacagatctgcgaagatcacatcaaagcacagattcatcaattcagagaggattcattggatagcgttctttttttaaagaagattgatagatgctggcaaaaccattgcagacaaatgatcatgatcaggagcatttttttgtttctggatagaacttacgttcttcagaattcaatgctaccctccatttgggacatgggactggagttatttagggctcatattataagtgatcagaaagtgcagaataagacaattgatggcattcttctcttgattgagagggaaaggaatggtgaagcaattgatagaagtttacttcgaagccttttaagcatgctgtctgatttgcaaatttatcaagattcttttgaacaacgatttttggaagaaactaaccggctctatgcagctgaaggccaaaaattaatgcaagaaagagaggttcctgaatatctacatcatgttaacaaacgtctagaagaagaagcagacagacttattacttacttagatcagaccacccagaagtcattaattgctactgtagaaaaacaacttctaggtgaacacttaacagcaattcttcagaaaggtttaaataacctccttgatgaaaaccgaattcaagatttgtctcttctgtatcagctcttcagtagagttcgaggtggagttcaggttcttttgcagcagtggatcgaatatatcaaggcatttggcagcactattgtaattaatcctgaaaaagataaaaccatggttcaagaattgctggattttaaagataaggttgaccatataattgatatctgctttctgaagaatgagaaatttatcaatgccatgaaagaagcatttgaaacgttcattaacaaaagaccaaataaaccagctgaacttatagctaagtatgtagattcaaaacttcgtgcaggcaacaaagaagctacagatgaagaacttgagaaaatgttggataaaattatgatcatatttagatttatctatggcaaggatgtttttgaggccttctataagaaagatttagccaagcgcctgttagtcggaaagagtgcatctgtagatgctgaaaaatcaatgctgtccaaacttaaacatgaatgcggagctgctttcaccagcaaacttgaaggaatgtttaaagacatggaactttctaaagacatcatgattcagttcaaacagtatatgcagaatcagaatgttccgggaaatattgagttaactgtgaatatcctgacaatgggctattggccgacatatgtgcctatggaagttcatttaccaccagagatggtaaaacttcaggagattttcaagacattttacctaggcaaacatagtggcaggaaacttcagtggcagtcaaccctaggacactgtgtgttaaaagcagaatttaaagagggtaaaaaggaactccaggtctctctttttcaaacactggtgctgctaatgtttaatgagggagaggagttcagtttagaagagatcaagcaggcaactggaatagaggatggagagttaaggagaacactgcagtcattagcctgtggcaaagctagagttctggcgaaaaatccaaagggcaaagacattgaagatggtgacaagttcatttgtaatgatgatttcaaacataaacttttcaggataaagatcaatcaaatccagatgaaagaaacggttgaagaacaagcaagcactacagaaagagtatttcaagacagacagtatcaaattgatgctgcaattgttcgaattatgaagatgagaaagacacttagccacaatctccttgtttcagaagtgtacaaccagttgaaatttccagtaaagcctgctgatcttaagaagagaatagaatctttaattgaccgggactacatggaaagagataaagaaaatccaaaccagtacaactatattgcatagaatgttggccttgcagcatttggtgtcatatgcagtagccagtggataaactaacctgttgattcaatattatttgactccttttttactaccgatgaccaaatgaagcagtgtaattaatggaaatagttgagtggactttttctcagtggttaacatgcccattttaaagagtaatacttacctttaagaagaatgttgttgaactctttgcatgttatttagtatgatgtgcagaaaacacttaagaacgtacctggtcttcatgaattcctctttggaactgggaaagagatccctgtggctattaaaaaggggggagggttcttacacaccattaattatgaagcaaaaggtttatttgcttaaaatgtcatttaaagatacttaaactgcatgcaaactttatttactgtacagagttctggatgtatttatcaaatagaaaaaccacccttgacttggttgttcacccgttttgtgatttcccttgaaaagagaaatgaattgtcatagctattgatattttactaggtgatgttctgttacactgaaagggatgttttttaaaaaaaattatttggaaacaagttttcaagtagggggacagttgcttacataatatcttgtatattcacatcctaaaaattttcatttatgagtatgggatgtgtgtatatggcttagccccaagttaactgtgctgattaacaagtacttataaaaatagctaaagtagaaaattaatgatcagttgtactagaggaacatcatagaagagaaaaatccaactctttatattaaaaatgaatacaataagaaaattgcaaaagagaccaaaatgaacgtgttttgtaaattgttacaggagcaaaaactttgcaactagttttcaacatactttagactttaaatgttgtttggacagttttgtcttcaacttggaccaattgtagattgttacaggcttcctaggatttagcattcctattttctctaccaaagttttttttagaagcatcccaactcttctctttgttgataaataagcctttcctgtcatcttcattttaacttgctaaaaccctagatacaaaggtcctccctcatttttcccacagagcccctgtttgggaatttgagattctgtgtcatgctggttttcctttcagaattgcttgaaatcgagttctcttagccactggacacctagttttcaggagaatgtcccaagattgtttatatatacaaaatggcaaaagtactgtttttcgaattgataattcaagcaaaggcttctctttactgtcactgatttttttttgtttttattttgtttccttgtttctatttccttgaagctttgaagggaggagaagcagaaaattttggtttatgtttgttaaaaatcagaactacttaatgctttttgccacagcatatttccttgcctgttggagccgttaggaagattacctatgtcctaatcttcaacctgagaagatttttgactcttgtgtctactgttgattgtttgcttgagttctcaaagacctgtggccaggtattttaaaaagtcgtctatttctttctagttgcatcaacttgcacactggtgtctaactatatgtggtattcggaacttgtaattcttattgagcagccattgcctatattttctcagctcctcactgatttctttatatgagctcagctgacaagcaaatgcagctattttgtttaccctctcttcataccggaccatcaacaacagtgttctaactcatccctgatggtctgtgagatgtagactattacacaagattcaagttactcgtaagcaacttttagatagagttggtcctgttaggaggagactcttgatgtcaccttcagtatcttgaaagcgggtcccctccccgaggctcttaattctttgaaaacttgatgctgtttcagctgaaaaattagcaagactgttaaaaaaaaaaagttgaggggagctgtttaagaaactgaaaagtaattgcaaactacattggataattgtgactttcagttgttgttctgtatcagttgaatttttgtgctcttttccctgtgtacgtggtggttctatttttctccaataaaacttttatttaccaaaagtttctagagaagat

SEQ ID NO: 307158 - DNA, 5225 bp, Homo sapiens
agtggtagctccaagtggtaggcatgagacctggcccagagatacaagatctcccttggaattttccaaatcaaaggcctctgttgttagactaatggggtttcccctgcagagattggtcagccctgcagtctatcatcccggaaggtgttaaatacacatgaaagccagcctcggcgggcagaacctagcccgccgaaagggcgggcattgctaaagtgttttcaaaaggtcttcccaatcctctgctttagacagctcggaccttagatagaagaacacaacggatcctccagtgactgacgacccaaaggacggatgatgtcacagtcatctggatcaggagatgggaatgatgatgaggctactacctctaaagacggtggtttttcttcccccagtccctcagctgctgctgctgctcaggaggtcagatctgccactgatggtaataccagcaccactccgcccacctctgccaagaagagaaagttaaacagcagcagcagtagcagcagtaacagtagtaacgagagagaagactttgattccacctcttcctcctcttccactcctcctttacaacccagggattcggcatccccttcaacctcgtccttctgcctgggggtttcagtggctgcttccagccacgtaccgatacagaagaagctgcgttttgaagacaccctggagtttgtagggtttgatgcgaagatggctgaggaatcctcctcctcctcctcctcatcttcaccaactgctgcaacatctcagcagcagcaacttaaaaataagagtatattaatctcttctgtggcttcggtgcatcatgcaaacggcctagccaaatcttctaccaccgtctctagctttgctaacagcaaacctggctctgctaagaagttagtgatcaagaactttaaagataagcctaaattaccagaaaactacacagatgaaacctggcaaaaactgaaagaagcagtggaagctattcagaatagtacttcaattaagtacaatttagaagaactctaccaggctgtagaaaatctctgttcttacaagatttctgcaaacttgtacaaacagctgagacagatctgcgaagatcacatcaaagcacagattcatcaattcagagaggattcattggatagcgttctttttttaaagaagattgatagatgctggcaaaaccattgcagacaaatgatcatgatcaggagcatttttttgtttctggatagaacttacgttcttcagaattcaatgctaccctccatttgggacatgggactggagttatttagggctcatattataagtgatcagaaagtgcagaataagacaattgatggcattcttctcttgattgagagggaaaggaatggtgaagcaattgatagaagtttacttcgaagccttttaagcatgctgtctgatttgcaaatttatcaagattcttttgaacaacgatttttggaagaaactaaccggctctatgcagctgaaggccaaaaattaatgcaagaaagagaggttcctgaatatctacatcatgttaacaaacgtctagaagaagaagcagacagacttattacttacttagatcagaccacccagaagtcattaattgctactgtagaaaaacaacttctaggtgaacacttaacagcaattcttcagaaaggtttaaataacctccttgatgaaaaccgaattcaagatttgtctcttctgtatcagctcttcagtagagttcgaggtggagttcaggttcttttgcagcagtggatcgaatatatcaaggcatttggcagcactattgtaattaatcctgaaaaagataaaaccatggttcaagaattgctggattttaaagataaggttgaccatataattgatatctgctttctgaagaatgagaaatttatcaatgccatgaaagaagcatttgaaacgttcattaacaaaagaccaaataaaccagctgaacttatagctaagtatgtagattcaaaacttcgtgcaggcaacaaagaagctacagatgaagaacttgagaaaatgttggataaaattatgatcatatttagatttatctatggcaaggatgtttttgaggccttctataagaaagatttagccaagcgcctgttagtcggaaagagtgcatctgtagatgctgaaaaatcaatgctgtccaaacttaaacatgaatgcggagctgctttcaccagcaaacttgaaggaatgtttaaagacatggaactttctaaagacatcatgattcagttcaaacagtatatgcagaatcagaatgttccgggaaatattgagttaactgtgaatatcctgacaatgggctattggccgacatatgtgcctatggaagttcatttaccaccagagatggtaaaacttcaggagattttcaagacattttacctaggcaaacatagtggcaggaaacttcagtggcagtcaaccctaggacactgtgtgttaaaagcagaatttaaagagggtaaaaaggaactccaggtctctctttttcaaacactggtgctgctaatgtttaatgagggagaggagttcagtttagaagagatcaagcaggcaactggaatagaggatggagagttaaggagaacactgcagtcattagcctgtggcaaagctagagttctggcgaaaaatccaaagggcaaagacattgaagatggtgacaagttcatttgtaatgatgatttcaaacataaacttttcaggataaagatcaatcaaatccagatgaaagaaacggttgaagaacaagcaagcactacagaaagagtatttcaagacagacagtatcaaattgatgctgcaattgttcgaattatgaagatgagaaagacacttagccacaatctccttgtttcagaagtgtacaaccagttgaaatttccagtaaagcctgctgatcttaagaagagaatagaatctttaattgaccgggactacatggaaagagataaagaaaatccaaaccagtacaactatattgcatagaatgttggccttgcagcatttggtgtcatatgcagtagccagtggataaactaacctgttgattcaatattatttgactccttttttactaccgatgaccaaatgaagcagtgtaattaatggaaatagttgagtggactttttctcagtggttaacatgcccattttaaagagtaatacttacctttaagaagaatgttgttgaactctttgcatgttatttagtatgatgtgcagaaaacacttaagaacgtacctggtcttcatgaattcctctttggaactgggaaagagatccctgtggctattaaaaaggggggagggttcttacacaccattaattatgaagcaaaaggtttatttgcttaaaatgtcatttaaagatacttaaactgcatgcaaactttatttactgtacagagttctggatgtatttatcaaatagaaaaaccacccttgacttggttgttcacccgttttgtgatttcccttgaaaagagaaatgaattgtcatagctattgatattttactaggtgatgttctgttacactgaaagggatgttttttaaaaaaaattatttggaaacaagttttcaagtagggggacagttgcttacataatatcttgtatattcacatcctaaaaattttcatttatgagtatgggatgtgtgtatatggcttagccccaagttaactgtgctgattaacaagtacttataaaaatagctaaagtagaaaattaatgatcagttgtactagaggaacatcatagaagagaaaaatccaactctttatattaaaaatgaatacaataagaaaattgcaaaagagaccaaaatgaacgtgttttgtaaattgttacaggagcaaaaactttgcaactagttttcaacatactttagactttaaatgttgtttggacagttttgtcttcaacttggaccaattgtagattgttacaggcttcctaggatttagcattcctattttctctaccaaagttttttttagaagcatcccaactcttctctttgttgataaataagcctttcctgtcatcttcattttaacttgctaaaaccctagatacaaaggtcctccctcatttttcccacagagcccctgtttgggaatttgagattctgtgtcatgctggttttcctttcagaattgcttgaaatcgagttctcttagccactggacacctagttttcaggagaatgtcccaagattgtttatatatacaaaatggcaaaagtactgtttttcgaattgataattcaagcaaaggcttctctttactgtcactgatttttttttgtttttattttgtttccttgtttctatttccttgaagctttgaagggaggagaagcagaaaattttggtttatgtttgttaaaaatcagaactacttaatgctttttgccacagcatatttccttgcctgttggagccgttaggaagattacctatgtcctaatcttcaacctgagaagatttttgactcttgtgtctactgttgattgtttgcttgagttctcaaagacctgtggccaggtattttaaaaagtcgtctatttctttctagttgcatcaacttgcacactggtgtctaactatatgtggtattcggaacttgtaattcttattgagcagccattgcctatattttctcagctcctcactgatttctttatatgagctcagctgacaagcaaatgcagctattttgtttaccctctcttcataccggaccatcaacaacagtgttctaactcatccctgatggtctgtgagatgtagactattacacaagattcaagttactcgtaagcaacttttagatagagttggtcctgttaggaggagactcttgatgtcaccttcagtatcttgaaagcgggtcccctccccgaggctcttaattctttgaaaacttgatgctgtttcagctgaaaaattagcaagactgttaaaaaaaaaaagttgaggggagctgtttaagaaactgaaaagtaattgcaaactacattggataattgtgactttcagttgttgttctgtatcagttgaatttttgtgctcttttccctgtgtacgtggtggttctatttttctccaataaaacttttatttaccaaaagtttctagagaagat

SEQ ID NO: 307159 - DNA, 3388 bp, Homo sapiens
cctttcaatcgatttcctcttttgtcactcatgtctatgtatatatgatgaaaacataaattgagcaagctcctgaggtttccaacttattgtacataatatccagagttgttttttttaagataaagcattgttcttggttttattatttgtataaaaatttcccatttattttatacctaaatagtagataaggttactacaggattaaagagtttgactctgaattaatggggcatacactttggggtaaggatttctttttattcttatgaaagttacagatcatacttcatactaaagttttgtatttcgtgtttcccacttttaaacctcttttgtttttaccactttaaaatattatacatgtacaaacatctttaatagaatgcggagctgctttcaccagcaaacttgaaggaatgtttaaagacatggaactttctaaagacatcatgattcagttcaaacagtatatgcagaatcagaatgttccgggaaatattgagttaactgtgaatatcctgacaatgggctattggccgacatatgtgcctatggaagttcatttaccaccagagatggtaaaacttcaggagattttcaagacattttacctaggcaaacatagtggcaggaaacttcagtggcagtcaaccctaggacactgtgtgttaaaagcagaatttaaagagggtaaaaaggaactccaggtctctctttttcaaacactggtgctgctaatgtttaatgagggagaggagttcagtttagaagagatcaagcaggcaactggaatagaggatggagagttaaggagaacactgcagtcattagcctgtggcaaagctagagttctggcgaaaaatccaaagggcaaagacattgaagatggtgacaagttcatttgtaatgatgatttcaaacataaacttttcaggataaagatcaatcaaatccagatgaaagaaacggttgaagaacaagcaagcactacagaaagagtatttcaagacagacagtatcaaattgatgctgcaattgttcgaattatgaagatgagaaagacacttagccacaatctccttgtttcagaagtgtacaaccagttgaaatttccagtaaagcctgctgatcttaagaagagaatagaatctttaattgaccgggactacatggaaagagataaagaaaatccaaaccagtacaactatattgcatagaatgttggccttgcagcatttggtgtcatatgcagtagccagtggataaactaacctgttgattcaatattatttgactccttttttactaccgatgaccaaatgaagcagtgtaattaatggaaatagttgagtggactttttctcagtggttaacatgcccattttaaagagtaatacttacctttaagaagaatgttgttgaactctttgcatgttatttagtatgatgtgcagaaaacacttaagaacgtacctggtcttcatgaattcctctttggaactgggaaagagatccctgtggctattaaaaaggggggagggttcttacacaccattaattatgaagcaaaaggtttatttgcttaaaatgtcatttaaagatacttaaactgcatgcaaactttatttactgtacagagttctggatgtatttatcaaatagaaaaaccacccttgacttggttgttcacccgttttgtgatttcccttgaaaagagaaatgaattgtcatagctattgatattttactaggtgatgttctgttacactgaaagggatgttttttaaaaaaaattatttggaaacaagttttcaagtagggggacagttgcttacataatatcttgtatattcacatcctaaaaattttcatttatgagtatgggatgtgtgtatatggcttagccccaagttaactgtgctgattaacaagtacttataaaaatagctaaagtagaaaattaatgatcagttgtactagaggaacatcatagaagagaaaaatccaactctttatattaaaaatgaatacaataagaaaattgcaaaagagaccaaaatgaacgtgttttgtaaattgttacaggagcaaaaactttgcaactagttttcaacatactttagactttaaatgttgtttggacagttttgtcttcaacttggaccaattgtagattgttacaggcttcctaggatttagcattcctattttctctaccaaagttttttttagaagcatcccaactcttctctttgttgataaataagcctttcctgtcatcttcattttaacttgctaaaaccctagatacaaaggtcctccctcatttttcccacagagcccctgtttgggaatttgagattctgtgtcatgctggttttcctttcagaattgcttgaaatcgagttctcttagccactggacacctagttttcaggagaatgtcccaagattgtttatatatacaaaatggcaaaagtactgtttttcgaattgataattcaagcaaaggcttctctttactgtcactgatttttttttgtttttattttgtttccttgtttctatttccttgaagctttgaagggaggagaagcagaaaattttggtttatgtttgttaaaaatcagaactacttaatgctttttgccacagcatatttccttgcctgttggagccgttaggaagattacctatgtcctaatcttcaacctgagaagatttttgactcttgtgtctactgttgattgtttgcttgagttctcaaagacctgtggccaggtattttaaaaagtcgtctatttctttctagttgcatcaacttgcacactggtgtctaactatatgtggtattcggaacttgtaattcttattgagcagccattgcctatattttctcagctcctcactgatttctttatatgagctcagctgacaagcaaatgcagctattttgtttaccctctcttcataccggaccatcaacaacagtgttctaactcatccctgatggtctgtgagatgtagactattacacaagattcaagttactcgtaagcaacttttagatagagttggtcctgttaggaggagactcttgatgtcaccttcagtatcttgaaagcgggtcccctccccgaggctcttaattctttgaaaacttgatgctgtttcagctgaaaaattagcaagactgttaaaaaaaaaaagttgaggggagctgtttaagaaactgaaaagtaattgcaaactacattggataattgtgactttcagttgttgttctgtatcagttgaatttttgtgctcttttccctgtgtacgtggtggttctatttttctccaataaaacttttatttaccaaaagtttctagagaagat

SEQ ID NO: 307160 - DNA, 5088 bp, Homo sapiens
gagagatcgaaaagcaggggagggggacggcacggccgtttacctgtctgcctcctcattcgctctcccccctcgttctgctcactcctggtgtcagcctatccgccttcccaaaccctcccattcccccggtgtagccccccccttcactttccttctcgtcctctgtgtttctcctctcttctttcttcccttccccctctagcattgctaccttctctcctacacgcacgcaggcatataaacgtaggtttttgatgctcctctgcctgttgaccccgctattttcatgtttccaacaggtttttcttcccccagtccctcagctgctgctgctgctcaggaggtcagatctgccactgatggtaataccagcaccactccgcccacctctgccaagaagagaaagttaaacagcagcagcagtagcagcagtaacagtagtaacgagagagaagactttgattccacctcttcctcctcttccactcctcctttacaacccagggattcggcatccccttcaacctcgtccttctgcctgggggtttcagtggctgcttccagccacgtaccgatacagaagaagctgcgttttgaagacaccctggagtttgtagggtttgatgcgaagatggctgaggaatcctcctcctcctcctcctcatcttcaccaactgctgcaacatctcagcagcagcaacttaaaaataagagtatattaatctcttctgtggcttcggtgcatcatgcaaacggcctagccaaatcttctaccaccgtctctagctttgctaacagcaaacctggctctgctaagaagttagtgatcaagaactttaaagataagcctaaattaccagaaaactacacagatgaaacctggcaaaaactgaaagaagcagtggaagctattcagaatagtacttcaattaagtacaatttagaagaactctaccaggctgtagaaaatctctgttcttacaagatttctgcaaacttgtacaaacagctgagacagatctgcgaagatcacatcaaagcacagattcatcaattcagagaggattcattggatagcgttctttttttaaagaagattgatagatgctggcaaaaccattgcagacaaatgatcatgatcaggagcatttttttgtttctggatagaacttacgttcttcagaattcaatgctaccctccatttgggacatgggactggagttatttagggctcatattataagtgatcagaaagtgcagaataagacaattgatggcattcttctcttgattgagagggaaaggaatggtgaagcaattgatagaagtttacttcgaagccttttaagcatgctgtctgatttgcaaatttatcaagattcttttgaacaacgatttttggaagaaactaaccggctctatgcagctgaaggccaaaaattaatgcaagaaagagaggttcctgaatatctacatcatgttaacaaacgtctagaagaagaagcagacagacttattacttacttagatcagaccacccagaagtcattaattgctactgtagaaaaacaacttctaggtgaacacttaacagcaattcttcagaaaggtttaaataacctccttgatgaaaaccgaattcaagatttgtctcttctgtatcagctcttcagtagagttcgaggtggagttcaggttcttttgcagcagtggatcgaatatatcaaggcatttggcagcactattgtaattaatcctgaaaaagataaaaccatggttcaagaattgctggattttaaagataaggttgaccatataattgatatctgctttctgaagaatgagaaatttatcaatgccatgaaagaagcatttgaaacgttcattaacaaaagaccaaataaaccagctgaacttatagctaagtatgtagattcaaaacttcgtgcaggcaacaaagaagctacagatgaagaacttgagaaaatgttggataaaattatgatcatatttagatttatctatggcaaggatgtttttgaggccttctataagaaagatttagccaagcgcctgttagtcggaaagagtgcatctgtagatgctgaaaaatcaatgctgtccaaacttaaacatgaatgcggagctgctttcaccagcaaacttgaaggaatgtttaaagacatggaactttctaaagacatcatgattcagttcaaacagtatatgcagaatcagaatgttccgggaaatattgagttaactgtgaatatcctgacaatgggctattggccgacatatgtgcctatggaagttcatttaccaccagagatggtaaaacttcaggagattttcaagacattttacctaggcaaacatagtggcaggaaacttcagtggcagtcaaccctaggacactgtgtgttaaaagcagaatttaaagagggtaaaaaggaactccaggtctctctttttcaaacactggtgctgctaatgtttaatgagggagaggagttcagtttagaagagatcaagcaggcaactggaatagaggatggagagttaaggagaacactgcagtcattagcctgtggcaaagctagagttctggcgaaaaatccaaagggcaaagacattgaagatggtgacaagttcatttgtaatgatgatttcaaacataaacttttcaggataaagatcaatcaaatccagatgaaagaaacggttgaagaacaagcaagcactacagaaagagtatttcaagacagacagtatcaaattgatgctgcaattgttcgaattatgaagatgagaaagacacttagccacaatctccttgtttcagaagtgtacaaccagttgaaatttccagtaaagcctgctgatcttaagaagagaatagaatctttaattgaccgggactacatggaaagagataaaggtgtcatatgcagtagccagtggataaactaacctgttgattcaatattatttgactccttttttactaccgatgaccaaatgaagcagtgtaattaatggaaatagttgagtggactttttctcagtggttaacatgcccattttaaagagtaatacttacctttaagaagaatgttgttgaactctttgcatgttatttagtatgatgtgcagaaaacacttaagaacgtacctggtcttcatgaattcctctttggaactgggaaagagatccctgtggctattaaaaaggggggagggttcttacacaccattaattatgaagcaaaaggtttatttgcttaaaatgtcatttaaagatacttaaactgcatgcaaactttatttactgtacagagttctggatgtatttatcaaatagaaaaaccacccttgacttggttgttcacccgttttgtgatttcccttgaaaagagaaatgaattgtcatagctattgatattttactaggtgatgttctgttacactgaaagggatgttttttaaaaaaaattatttggaaacaagttttcaagtagggggacagttgcttacataatatcttgtatattcacatcctaaaaattttcatttatgagtatgggatgtgtgtatatggcttagccccaagttaactgtgctgattaacaagtacttataaaaatagctaaagtagaaaattaatgatcagttgtactagaggaacatcatagaagagaaaaatccaactctttatattaaaaatgaatacaataagaaaattgcaaaagagaccaaaatgaacgtgttttgtaaattgttacaggagcaaaaactttgcaactagttttcaacatactttagactttaaatgttgtttggacagttttgtcttcaacttggaccaattgtagattgttacaggcttcctaggatttagcattcctattttctctaccaaagttttttttagaagcatcccaactcttctctttgttgataaataagcctttcctgtcatcttcattttaacttgctaaaaccctagatacaaaggtcctccctcatttttcccacagagcccctgtttgggaatttgagattctgtgtcatgctggttttcctttcagaattgcttgaaatcgagttctcttagccactggacacctagttttcaggagaatgtcccaagattgtttatatatacaaaatggcaaaagtactgtttttcgaattgataattcaagcaaaggcttctctttactgtcactgatttttttttgtttttattttgtttccttgtttctatttccttgaagctttgaagggaggagaagcagaaaattttggtttatgtttgttaaaaatcagaactacttaatgctttttgccacagcatatttccttgcctgttggagccgttaggaagattacctatgtcctaatcttcaacctgagaagatttttgactcttgtgtctactgttgattgtttgcttgagttctcaaagacctgtggccaggtattttaaaaagtcgtctatttctttctagttgcatcaacttgcacactggtgtctaactatatgtggtattcggaacttgtaattcttattgagcagccattgcctatattttctcagctcctcactgatttctttatatgagctcagctgacaagcaaatgcagctattttgtttaccctctcttcataccggaccatcaacaacagtgttctaactcatccctgatggtctgtgagatgtagactattacacaagattcaagttactcgtaagcaacttttagatagagttggtcctgttaggaggagactcttgatgtcaccttcagtatcttgaaagcgggtcccctccccgaggctcttaattctttgaaaacttgatgctgtttcagctgaaaaattagcaagactgttaaaaaaaaaaagttgaggggagctgtttaagaaactgaaaagtaattgcaaactacattggataattgtgactttcagttgttgttctgtatcagttgaatttttgtgctcttttccctgtgtacgtggtggttctatttttctccaataaaacttttatttaccaaaagtttctagagaagat

SEQ ID NO: 307161 - DNA, 2813 bp, Homo sapiens
gagagatcgaaaagcaggggagggggacggcacggccgtttacctgtctgcctcctcattcgctctcccccctcgttctgctcactcctggtgtcagcctatccgccttcccaaaccctcccattcccccggtgtagccccccccttcactttccttctcgtcctctgtgtttctcctctcttctttcttcccttccccctctagcattgctaccttctctcctacacgcacgcaggcatataaacgtaggtttttgatgctcctctgcctgttgaccccgctattttcatgtttccaacaggtttttcttcccccagtccctcagctgctgctgctgctcaggaggtcagatctgccactgatggtaataccagcaccactccgcccacctctgccaagaagagaaagttaaacagcagcagcagtagcagcagtaacagtagtaacgagagagaagactttgattccacctcttcctcctcttccactcctcctttacaacccagggattcggcatccccttcaacctcgtccttctgcctgggggtttcagtggctgcttccagccacgtaccgatacagaagaagctgcgttttgaagacaccctggagtttgtagggtttgatgcgaagatggctgaggaatcctcctcctcctcctcctcatcttcaccaactgctgcaacatctcagcagcagcaacttaaaaataagagtatattaatctcttctgtggcttcggtgcatcatgcaaacggcctagccaaatcttctaccaccgtctctagctttgctaacagcaaacctggctctgctaagaagttagtgatcaagaactttaaagataagcctaaattaccagaaaactacacagatgaaacctggcaaaaactgaaagaagcagtggaagctattcagaatagtacttcaattaagtacaatttagaagaactctaccaggctgtagaaaatctctgttcttacaagatttctgcaaacttgtacaaacagctgagacagatctgcgaagatcacatcaaagcacagattcatcaattcagagaggattcattggatagcgttctttttttaaagaagattgatagatgctggcaaaaccattgcagacaaatgatcatgatcaggagcatttttttgtttctggatagaacttacgttcttcagaattcaatgctaccctccatttgggacatgggactggagttatttagggctcatattataagtgatcagaaagtgcagaataagacaattgatggcattcttctcttgattgagagggaaaggaatggtgaagcaattgatagaagtttacttcgaagccttttaagcatgctgtctgatttgcaaatttatcaagattcttttgaacaacgatttttggaagaaactaaccggctctatgcagctgaaggccaaaaattaatgcaagaaagagaggttcctgaatatctacatcatgttaacaaacgtctagaagaagaagcagacagacttattacttacttagatcagaccacccagaagtcattaattgctactgtagaaaaacaacttctaggtgaacacttaacagcaattcttcagaaaggtttaaataacctccttgatgaaaaccgaattcaagatttgtctcttctgtatcagctcttcagtagagttcgaggtggagttcaggttcttttgcagcagtggatcgaatatatcaaggcatttggcagcactattgtaattaatcctgaaaaagataaaaccatggttcaagaattgctggattttaaagataaggttgaccatataattgatatctgctttctgaagaatgagaaatttatcaatgccatgaaagaagcatttgaaacgttcattaacaaaagaccaaataaaccagctgaacttatagctaagtatgtagattcaaaacttcgtgcaggcaacaaagaagctacagatgaagaacttgagaaaatgttggataaaattatgatcatatttagatttatctatggcaaggatgtttttgaggccttctataagaaagatttagccaagcgcctgttagtcggaaagagtgcatctgtagatgctgaaaaatcaatgctgtccaaacttaaacatgaatgcggagctgctttcaccagcaaacttgaaggaatgtttaaagacatggaactttctaaagacatcatgattcagttcaaacagtatatgcagaatcagaatgttccgggaaatattgagttaactgtgaatatcctgacaatgggctattggccgacatatgtgcctatggaagttcatttaccaccagagatggtaaaacttcaggagattttcaagacattttacctaggcaaacatagtggcaggaaacttcagtggcagtcaaccctaggacactgtgtgttaaaagcagaatttaaagagggtaaaaaggaactccaggtctctctttttcaaacactggtgctgctaatgtttaatgagggagaggagttcagtttagaagagatcaagcaggcaactggaatagaggatggagagttaaggagaacactgcagtcattagcctgtggcaaagctagagttctggcgaaaaatccaaagggcaaagacattgaagatggtgacaagttcatttgtaatgatgatttcaaacataaacttttcaggataaagatcaatcaaatccagatgaaagaaacggtatttctttcactttctcttagtcctaacacactggaattatacatgttaataatcaaaatatataaagatttttatacctgta

SEQ ID NO: 307162 - DNA, 1213 bp, Homo sapiens
agtggtagctccaagtggtaggcatgagacctggcccagagatacaagatctcccttggaattttccaaatcaaaggcctctgttgttagactaatggggtttcccctgcagagattggtcagccctgcagtctatcatcccggaaggtgttaaatacacatgaaagccagcctcggcgggcagaacctagcccgccgaaagggcgggcattgctaaagtgttttcaaaaggtcttcccaatcctctgctttagacagctcggaccttagatagaagaacacaacggatcctccagtgactgacgacccaaaggacggatgatgtcacagtcatctggatcaggagatgggaatgatgatgaggctactacctctaaagacggtggcctactgaacatcagtcacacagcatggtaatatggttgttccaacgtatctgcagggaactggctccaggaaccctgcagataccaaaatcggtgcatattcaactcccacagtcagctctgcggaacccacagatacaaaaagttggccttccctttacaggtttccaatcctgcaaatcctgtattttccattcctgcttgattgctgatgtggaacccgcccatgcagagggccgactgtatttattgaaaaaatatgtgtataaatggaccatcacagtttaaaccccaattgttcaagggtcacctgtaaacagttgcctaaatgggccatgatctttctcatgcctccatgtctttgcacacactgttccccttttcaagtaatccatagatctctagatctcactgtcctgatactacaaattaagtttggatttgtatgattaatatacaggttacaacgttaagcccccatattgtggaccatagagagtccattcttccaccaggttggagggtgcatcccccgcccttgagtaatttccagaaatccacaaggtatgcttaaatgttacaaaaatcaatcctagttgtcatttgttatctctgccagctattctttctgcatactgtcatggtctgccttcaataagtcaccacttcctgtcttgaaactttttttaaaaaaaccttttagtttttttaattttaaaaatttctgcaaacactatggcgacttgtgtaattttaatacatacaaaagatgtatgatgtgtaatttatggagcataattattaaataaacatccaggaatctatca

SEQ ID NO: 307163 - DNA, 1077 bp, Homo sapiens
agtggtagctccaagtggtaggcatgagacctggcccagagatacaagatctcccttggaattttccaaatcaaaggcctctgttgttagactaatggggtttcccctgcagagattggtcagccctgcagtctatcatcccggaaggtgttaaatacacatgaaagccagcctcggcgggcagaacctagcccgccgaaagggcgggcattgctaaagtgttttcaaaaggtcttcccaatcctctgctttagacagctcggaccttagatagaagaacacaacggatcctccagtgactgacgacccaaaggacggatgatgtcacagtcatctggatcaggagatgggaatgatgatgaggctactacctctaaagacggtggcctactgaacatcagtcacacagcatggtttccaatcctgcaaatcctgtattttccattcctgcttgattgctgatgtggaacccgcccatgcagagggccgactgtatttattgaaaaaatatgtgtataaatggaccatcacagtttaaaccccaattgttcaagggtcacctgtaaacagttgcctaaatgggccatgatctttctcatgcctccatgtctttgcacacactgttccccttttcaagtaatccatagatctctagatctcactgtcctgatactacaaattaagtttggatttgtatgattaatatacaggttacaacgttaagcccccatattgtggaccatagagagtccattcttccaccaggttggagggtgcatcccccgcccttgagtaatttccagaaatccacaaggtatgcttaaatgttacaaaaatcaatcctagttgtcatttgttatctctgccagctattctttctgcatactgtcatggtctgccttcaataagtcaccacttcctgtcttgaaactttttttaaaaaaaccttttagtttttttaattttaaaaatttctgcaaacactatggcgacttgtgtaattttaatacatacaaaagatgtatgatgtgtaatttatggagcataattattaaataaacatccaggaatctatca

SEQ ID NO: 307164 - DNA, 320 bp, Homo sapiens
ttttcatgatacttttctctaaaaaagagatttaaataaataaaaattttaaaaaaggagattaaattcatgagccgaaactgttgtctttttaatggggtattaactaaatgggcttgagccaatgataatgaactttacattgaaaatttgccttctcttacagcctgctgatcttaagaagagaatagaatctttaattgaccgggactacatggaaagagataaagaaaatccaaaccagtacaactatattgcatagaatgttggccttgcagcatttggtgtcatatgcagtagccagtggataaactaacctg

SEQ ID NO: 307165 - DNA, 427 bp, Homo sapiens
gacaagcaaatgcagctattttgtttaccctctcttcataccggaccatcaacaacagtgttctaactcatccctgatggtctgtgagatgtagactattacacaagattcaagttactcgtaagcaacttttagatagagttggtcctgttaggaggagactcttgatgtcaccttcagtatcttgaaagcgggtcccctccccgaggctcttaattctttgaaaacttgatgctgtttcagctgaaaaattagcaagactgttaaaaaaaaaaagttgaggggagctgtttaagaaactgaaaagtaattgcaaactacattggataattgtgactttcagttgttgttctgtatcagttgaatttttgtgctcttttccctgtgtacgtggtggttctatttttctccaataaaacttttattt

SEQ ID NO: 307166 - DNA, 1422 bp, Homo sapiens
aagagacacacagctatgaacacaaagcacagaacctagaggaaaatgtgttcatatggtgaggtttcattcacaacaacatggacaggactgctgctcatattacacaacagccataaaacccaaaaatacatctaaaacaaaggaaacatatgtggttcaattccaccaagggatactacgaggccgtgcagaggcacagacaaaatctacaaagagcaatgcaaaccaaccttccatcatgatgttgagtaaagaaacaagagtataaaaagaaggtgtgcacatgaagctcaaaaagaggcagcatttattttctagggaggcaaactcaaaatagaccccataaataaaggaaatagattatgtaatccaaaatagtgcttgcacatcaggaaatactggagggttctgttcaacatggaaactccaaggaccactggacgcgggcactggaacgctgactttcatttggtgaccctcaatccacttcgagttattggtaaatcacataattttaatttgatacggaataatcatacatgtttcttgggagcatgtggtaatctgattcatccatgcaatgtgtaacgatccaataaaggttcccaggacattcatcaccctgaacatttgttattatggttattattttgagacagagtcttgcactgtcgcccagctggcgtgcagtggcaggatcttggctcactgcaaactctgcctcccgggttcaagcagttttcctgtctcagcctcctgagtagctaggattacaggcatgcaccatcacacctcgctaatttttgtatttttattacagacggggtttcaccatgttgctctggctggtctcgaactcctgacctaaggtgatccaccagcgtcggctttccatagtgctgggattacaggtgtgagccactatgcctggccaacttttataatttctgtgctgggaacattccaaatcttcatttctcactcatgtggaaaatacaataatctgttgctaactatggtcaccctactgagctctcaggccctggaacttactccttctctccacctgtatttctgcacccgtccaccaacctctctccatccctgtcctccacactcccttgccagcctctgttgacaaccattctactctctgccatcacaaggcccacttttgtagcttccgcgtgagtgagaacatgctcctctttctgggcctggcttatttcactgaacataatgtcttccagattcatctgtgttgctgaacatggtacaatttccttctttttatgcctgaatattatttcattgtgtatatagaccacatgttccttatccattcatccattgatggacataggttgattccatatcttggctattgtgaatactgctgcaataaacatggcaatgcag

SEQ ID NO: 307167 - DNA, 6439 bp, Homo sapiens
  misc_feature (464)..(464): n is a, c, g, or t
  misc_feature (934)..(934): n is a, c, g, or t
  misc_feature (1411)..(1411): n is a, c, g, or t
  misc_feature (2435)..(2435): n is a, c, g, or t
  misc_feature (2459)..(2460): n is a, c, g, or t
  misc_feature (2757)..(2758): n is a, c, g, or t
  misc_feature (3818)..(3818): n is a, c, g, or t
  misc_feature (3938)..(3938): n is a, c, g, or t
  misc_feature (5757)..(5757): n is a, c, g, or t
aacctctcactttccaaagaagctgtggacctatttctgtgtccagccattctgtgtggagaaactgaccatgttcctgatgtcccttaatttgcctttaaactgctgcctgattctcctccaatcctgattctctgagtttgggattttccaagactgttttctggaaacctgtacagttacttcttaggggtctgtattagtcggttctcacactgctaataaagacatacctgagaccaggcaatttataaagaaaaagaggtttaatggactcacagttccacatggctggagaagccacacaatcatggcagaggtgaaggaggagcagaggcacatcttacatggtggcaggcaagagagcgtgtgcaagggaactaccctttataaaaccatcagatctcatgagacttattcactatcacaagaacagcatgagaaaaacctgcctccatgattcnattacctcccaccaggtccttcccatgacatgtggggattatgggaactacaattcaagatgagatttgggtggggacacagccaaaccatatcagggtctttgcagaatcatgagtttatcagtactaattagtttttcctcccatgtcccatctactttgtatcttcccatattattcaaaatgtctgctttattgatggcatctttccctggttcccagcattgccagtgaatttaccattccccaaaccaaaagcccccgtatggaaatagtggagagttctgacacatcatatggatagatggaccaaatgaccttccagactcatgtaactctgggaggctttttctttaaagcagcataattaaagggttgagaaaaacttttactgaaaaggacagagagatagagtttagtttactcaggagaacagaataaggtgagacttaaatggtgagtcacactangcctgctgaagatacagcaggagggactaagattaaattacagctgaagtgattcatgttggtcactacaaagatcatttaacccttaaaaagttgtgtggcatcatgatacattgcaaagccaagttacaaagcctcatttttggagctgttctctttaaaggtaagaggatggactcgaatcaccttctgaattatcggacagccctgtgacatgattataccttggtgcctgagatgttagatgggaaataaacagcagcatctagtaaactctcctggggtaaaaaacaaaacaaaaaaaaaaaaaccatcttgttttcacccagtcttactgattttttttagtgtgaagacagaatgttttgtcaaaaacaagttctccaaatttataaacctgattggagacatctttagtttcttctcaaacatgctgggaaaataggaatgtcactgagactccttcaccatcccctngcagcccctattccccggggggctgggtagatggagaagcagggggcaggggctggaccagggagagagtgacaggctctctgtggtaggtctgtgccttgtcacagagcctcctgggctcaggtctgtggtggccgcgggagagccagctccacgctgtgtggctggtgacatttccggctgccagggcccagccaatcagtgatggacccagcttgcttgggcgatgacacatgaaatatgataattttctgccaaagggccctggaagaggggaaggaagagagtgtgtgtgtgtcgctgggaggggtccacacaggagcgcctgtgatgaggtgggagggtgacagtgcacttgttttcacggtttgcctggcaggactaggcaagggagggaatgggctgtgatgctggagcggctgtaggagcgcccctgtagctcccgaggtgagccactgccgctgctcttaggcgggaaccagcggaggagcagacagcgccatgctggagctctggggctggggtgaaaaagaaactgtcaaagacatttgccttcttaacacacgtgagcaaggttaggactcttgtttcttctcagcgctacctctttaaaagccagaacaaaactgcagtaaacaccatctgggtggctgaagtactcgaagaataatttttttcaaaaaaatttaggctggaggttgtctctccccctaccctgtttttctacctccatacctccatgctgacccttaaaagaaaagtgaaaaacaaaacaacagaactcaataacaaaatcttgaagaagggcctaagtctgaatcgtaaagactctaactaaggttcaggtggtagttctgattcctgattctggttgaaagaaagtatgtcttggaatgcgatgtggctctggattatgttcgactttagaaatagtgccagaactattctttgatttgtggacatggaccctgagactgcagagcaaggcagggcagggcaaggagtgcccgtgttgagctctcangtgcagagaccccactcccttcanncactgttgaggctccccggcccctgatctgcagccagaggctggtgaggtgtgacacgcttgctgacaagagtgccctgtctcgtctgacccgtgaacatgggtgttcagaagtgaaggatcatagtgtttacataacgtgccaattagtactgagaagctcatcagtgcaataaatatttatgacttgcatttgcattttttctctccacgtatatatatataatatgtgtgcatatatatgtgcatatatatgcacatatattatacatatatgttgtttttaaaaagcaccaannaatgaaatccttatcactgtgtgcaagcctactgtgcctttaggcatgggactggcttcctgcgctgggagtgacagctattccgaagtgataattggtgtactgtgtctttaaaggttaaaccccctttcaaaaaaggtctggactcctagtggaaaagacaagcgaggcatgggttggctctggattcagaaaacagctgctgattagattctgtgtctgcaggctgaatttattccgtgtttttcagcagcacgaattcaagagggatgcttctgtttgggtttctgatcgtgatttatatttattcagaggaataacagagggtggatctgttcccggcgcgagcatgctcacaaccagccgactctcccattatccagctgcctagtttggtgcttcaatgtacatggctattccgtgtgcatatgtgtgtatacaaacacgcatgcatgcctggatggacatacgtatgcacaggttattttttaaggacaattctttcaataaggtctttaccccttacttgaaacaggtgttcatgaaaaaaatgcacaaaatcctgcctggccggaataattcatgaagaaggggctggatccgtgggtcagagaacacaggaccagtttgccatcccaaggccgaaggtaggggactctgggtttttattcggcggatggattccttgcgctgtattttaccttgtgattgtgtttttgcctgaggccgcaccgcgaagcagaatagcgagctgcgattccattttgtgtatgcctttcttaggcaaggtgtccggctgccgagacgcaggggccggccgggtgggctgcgcgtggcggccagtgcccccgtgggctgagcgcgctgctcggcctggtgctggggagcggcgcgagcctcaagtgacccccgcgcgtcaatcacaggcggcggcggcggcggcggcggcggggctgtaaccctatgcgcgccgtgcgctccagcgctgcttgcagcaggctctgctgggctctgcacccgcgcactggcggccggctccataggagcctcggctgggggncttaggcatcgcgttccgtggcaccggcgttttcttgtgctgccttggctgctgctccggattgtttaggcggactgcagtagcctgcttggttgagagtgagattcgtatgatgctggntgctgagacagaggggatagctttctttttcccccttaatcctagccccctgaaaatattcctaaagcaaaatcatttcccaacccccaacctgacccaaccaaacccaaaccaaactcctattctataggggattcttgcctccctgctagcagagagagtgtcccctccaagttatgccccacattttactatcttttaaatggaaacactgatggtgccgaatggtccctaatgatattgtccaggctgctgaggactcctgagtgtggcagtggtgcagaggaacttggaggctcggcattggtttcctttaacgtagctggtttggtttctgttgcaggtcaggaatatttctgtggctaggcccttccttgaacttcgggggcagtggttgcaggaagagggtctgcagatctggtcgctgggtgagcagcaccctggccctctttctggtatacgctgacgtttctggtagcccttggcattgtaaccacagcagccaggtgcccactggctacctggagtgcttcggttttgttaactctggtgtgcattttgggtgttacggggggagggaagaggaaagagggagaatgaggtgtttgctgaactgatctgcatggcagtgttctccagcccatgtttgtgtgattatgtaatgatcagacgtgtgcccaaacagctccccaccatctcctggctctcccccagactgaagaagttgggtgctacagttgtttaagacgtctttatgtaattatgtgtatgctgggggcagggagagagtgggggcaaggaggaataattctagcaacttaaatgtgaagaatacaggtcagtgatcgtgtgtccctctgaggacagtgtggtattagctctgggtcagtgttgatctgaagaccctcctgtgtctctttcagccagtaattgcttatctgaactttcatttggtaatttcacccctcttgcaccctggagacagttggacccaggagaaggacccctgcagggcctccagtttcccaattccaggcagaaaatgaatcctgaagccaaggtaataggccaggtcccagctgttcttcatggtcctgctgagcagccagtgtagggaggagttcctgtccactagggtgtcacttgtgctctggggttgggctatactgtggggctgaagaatagacctcagatgccgtctgagctgtttgacatatgctctttaaagttgtgatggcttgcagaggctggaggccctttacatagttgcatttaaagattgtgggagttttttgcaaggaaggtggacagctgtccaactaagacacctgcaggcaggaggagagggtggtgtgacacttagctctctgcttcctctccactccatctagttaaggcacccacaggatacagaattgttaacaggggccctcctgtcacacccctgagcgcctcagcctggggctgttgggcagatttgttaatttgatggcaaagtctggccccttaaggctaagattgtttttttgccctcaacaccccagtgggtttgctttgagggccaactactactgtgaactctgtggcagtggatcaagatgtgctcaactggcactattgttgagctgtctccgcccattgtgtttagtggcagccaccctccttggagtggagaagtgtgtgctgcctttgggtccttgccaagtgagctgttgagacatttagtgtgtgaaaggtacaggcaagaagaagatgcatttagtctgaagtcctggcaggttctaggacatgatttgatgaaagataacattaagaaagntgtgtgacaactggatagcatttaacttgtctctcactccctactctgtgaattccctaatgtctttaaggctcttttttgccctccatcctgcccatcaaggagtccctgacatgctgttctccatcctgtttcctgtggagtcaaagtgtatttacaaatctgcagatgcactaggcgggcagggctggaaaacactggctgtatcaacaggcagcactagcattctgggtcagacttggccaaagcccgtgaccaattttcttccttatctgtaaagtaggtgtaaccatcataaccttaccaagaccactgaactatcttgagaagaaaaatgagatacgtttagtaacatgctatgtagttgataggtattaggataataccacaacaatctggaactcacatttacataatttcacttatccagttgggacctagatggcaaatcaagagaaaggtcataagtccatgagctacagtttatgaattttgatcattggaggaaattttataccctctttcaggcctctgcatttacttcaagttttaagaggcttggttattagtttgtcaaatgcacctagcaaattggaagcaactgatactgtactgtgcaaggattattaaagctcttttatcaagtatcagtaagaagtaagagtaaaaaacagaaaaacta

SEQ ID NO: 307168 - DNA, 2125 bp, Homo sapiens
ccgcgcgcgcacggctctcgcatgccgtggccgggtggctgcagcgctgcgccgcgccgcaccccggatccaagccgctcccgccgcccggccggcgcgcaggtgttcatgaaaaaaatgcacaaaatcctgcctggccggaataattcatgaagaaggggctggatccgtgggtcagagaacacaggaccagtttgccatcccaaggccgaagtcgagggacaaacgtcctgaagaatgggaagaaaggaggttctgaaggcacagattccaataccatgccagaggttgaggacactggtgcttgaagggaaactggcacactctggagccccaagaagagctggagctggaggcatgcggcccacgaagggtagaagtaccagccatgaccaagagcccttcacatcatctggcaatccatccagaacccactgaatggaggacagcacagcgaggtctttctcattttgtaactgcaaaagctggaacaagagccagagaagccaaagaagcagtacaagtccaacagcttttagaataaccctgagaaaatggttgaattttgaccagttttgcaattggatactatgagaagagaccttccctcctgcactggatttcatcatcatacctggaggccattcctcatgggactttggccatctcatatccacctttaagcatgttattcccatttcagctgtggtagctctgggtatccttccctaggagaaaatattaatcttttctccctctgagttctggattaaactgtcttatctgaaactgggtcactttaggctagaagcaccactagacattcctgttctcagaagttgccaagttcatgtcatatctgtttcattgttaacgggatccacttctgcaagaggctgcctggccagatcagtgtgtctcctggtcagctccttgatgcccttctcctctcccctgcccaatcccagctgagacttgcactgtggtgactctgtcccctcctggtgctttgactggatgtgtgagagaaagtatggtctgtggcactgacatctttgtgtgtttggaggtgactggaacacggatccacccctggaggaaggtggccgtgaaggaggccagcctcagctcagcgttctactctcatcgctcttactcccgcctttttagtgcctgccctactccaggataattgtgcttttcttttttcagttaaatgttagcattgctatttttcattattgcaaagcagcacatgcttgttacaaaaactttggaagtgtagacaaataaaaagaagaaaaagctacttccaaatcctacttaccccaaagacaagatgatcatttagtcatatagtatcatacatatataatatgtacacatatattttaatgtaagtgtagtgtcacaatatcatgtatagtctttcataaaacacgttggcacttaatatcttatatgaacaactttctagagcaacaagcttagtttacagcaattgtaatgtaagagtactcatttacatagctacagcatcctttgtttacctcatctcttatggtttgatgtttaggttgtttccaacttttctccacctaaacagcattaataaatgtggttttagtttcaaaaaaaaaaaaaaaaaaaaaaaaaaaaaaaaacaagaacaaacaccaacaaaaaaaacacaaaaaaaaacaacaaacacaaaacaacaaacaaaaaaaacgagcaaacacaacaaaaaagtaccaaacaacacaagaaacaagaactaaaaacaccaaccccaccagagaaacaaacaagaaaacaaacgaacaaaaaaaagaggagcaacataaaaaaaaacgaaaccacaagagaacagacaagaaacaaacaaaacaagacaagagagaaaaaaaaaatacagaaaaaaaagaaaaacaaaagacgaaagaaaaaagaaaaacaacgaaagaacagacaacaacatggccaaccaaaaaacagcagacaaaaaaataaagaacacacaaaacgaaaaaaaacacacaagaaaacacaaggacataacaccacacgaaaaaagagaagaaagcacaaaagaaagaaaaaaaaatataagacaacaaaaaca

SEQ ID NO: 307169 - DNA, 5370 bp, Homo sapiens
  misc_feature (464)..(464): n is a, c, g, or t
  misc_feature (934)..(934): n is a, c, g, or t
  misc_feature (1411)..(1411): n is a, c, g, or t
  misc_feature (2435)..(2435): n is a, c, g, or t
  misc_feature (2459)..(2460): n is a, c, g, or t
  misc_feature (2757)..(2758): n is a, c, g, or t
aacctctcactttccaaagaagctgtggacctatttctgtgtccagccattctgtgtggagaaactgaccatgttcctgatgtcccttaatttgcctttaaactgctgcctgattctcctccaatcctgattctctgagtttgggattttccaagactgttttctggaaacctgtacagttacttcttaggggtctgtattagtcggttctcacactgctaataaagacatacctgagaccaggcaatttataaagaaaaagaggtttaatggactcacagttccacatggctggagaagccacacaatcatggcagaggtgaaggaggagcagaggcacatcttacatggtggcaggcaagagagcgtgtgcaagggaactaccctttataaaaccatcagatctcatgagacttattcactatcacaagaacagcatgagaaaaacctgcctccatgattcnattacctcccaccaggtccttcccatgacatgtggggattatgggaactacaattcaagatgagatttgggtggggacacagccaaaccatatcagggtctttgcagaatcatgagtttatcagtactaattagtttttcctcccatgtcccatctactttgtatcttcccatattattcaaaatgtctgctttattgatggcatctttccctggttcccagcattgccagtgaatttaccattccccaaaccaaaagcccccgtatggaaatagtggagagttctgacacatcatatggatagatggaccaaatgaccttccagactcatgtaactctgggaggctttttctttaaagcagcataattaaagggttgagaaaaacttttactgaaaaggacagagagatagagtttagtttactcaggagaacagaataaggtgagacttaaatggtgagtcacactangcctgctgaagatacagcaggagggactaagattaaattacagctgaagtgattcatgttggtcactacaaagatcatttaacccttaaaaagttgtgtggcatcatgatacattgcaaagccaagttacaaagcctcatttttggagctgttctctttaaaggtaagaggatggactcgaatcaccttctgaattatcggacagccctgtgacatgattataccttggtgcctgagatgttagatgggaaataaacagcagcatctagtaaactctcctggggtaaaaaacaaaacaaaaaaaaaaaaaccatcttgttttcacccagtcttactgattttttttagtgtgaagacagaatgttttgtcaaaaacaagttctccaaatttataaacctgattggagacatctttagtttcttctcaaacatgctgggaaaataggaatgtcactgagactccttcaccatcccctngcagcccctattccccggggggctgggtagatggagaagcagggggcaggggctggaccagggagagagtgacaggctctctgtggtaggtctgtgccttgtcacagagcctcctgggctcaggtctgtggtggccgcgggagagccagctccacgctgtgtggctggtgacatttccggctgccagggcccagccaatcagtgatggacccagcttgcttgggcgatgacacatgaaatatgataattttctgccaaagggccctggaagaggggaaggaagagagtgtgtgtgtgtcgctgggaggggtccacacaggagcgcctgtgatgaggtgggagggtgacagtgcacttgttttcacggtttgcctggcaggactaggcaagggagggaatgggctgtgatgctggagcggctgtaggagcgcccctgtagctcccgaggtgagccactgccgctgctcttaggcgggaaccagcggaggagcagacagcgccatgctggagctctggggctggggtgaaaaagaaactgtcaaagacatttgccttcttaacacacgtgagcaaggttaggactcttgtttcttctcagcgctacctctttaaaagccagaacaaaactgcagtaaacaccatctgggtggctgaagtactcgaagaataatttttttcaaaaaaatttaggctggaggttgtctctccccctaccctgtttttctacctccatacctccatgctgacccttaaaagaaaagtgaaaaacaaaacaacagaactcaataacaaaatcttgaagaagggcctaagtctgaatcgtaaagactctaactaaggttcaggtggtagttctgattcctgattctggttgaaagaaagtatgtcttggaatgcgatgtggctctggattatgttcgactttagaaatagtgccagaactattctttgatttgtggacatggaccctgagactgcagagcaaggcagggcagggcaaggagtgcccgtgttgagctctcangtgcagagaccccactcccttcanncactgttgaggctccccggcccctgatctgcagccagaggctggtgaggtgtgacacgcttgctgacaagagtgccctgtctcgtctgacccgtgaacatgggtgttcagaagtgaaggatcatagtgtttacataacgtgccaattagtactgagaagctcatcagtgcaataaatatttatgacttgcatttgcattttttctctccacgtatatatatataatatgtgtgcatatatatgtgcatatatatgcacatatattatacatatatgttgtttttaaaaagcaccaannaatgaaatccttatcactgtgtgcaagcctactgtgcctttaggcatgggactggcttcctgcgctgggagtgacagctattccgaagtgataattggtgtactgtgtctttaaaggttaaaccccctttcaaaaaaggtctggactcctagtggaaaagacaagcgaggcatgggttggctctggattcagaaaacagctgctgattagattctgtgtctgcaggctgaatttattccgtgtttttcagcagcacgaattcaagagggatgcttctgtttgggtttctgatcgtgatttatatttattcagaggaataacagagggtggatctgttcccggcgcgagcatgctcacaaccagccgactctcccattatccagctgcctagtttggtgcttcaatgtacatggctattccgtgtgcatatgtgtgtatacaaacacgcatgcatgcctggatggacatacgtatgcacaggttattttttaaggacaattctttcaataaggtctttaccccttacttgaaacaggtgttcatgaaaaaaatgcacaaaatcctgcctggccggaataattcatgaagaaggggctggatccgtgggtcagagaacacaggaccagtttgccatcccaaggccgaagtctggtgtctcggatttgttcctgtgttgcccactcctgctggatcttgtccagtcgagggacaaacgtcctgaagaatgggaagaaaggaggttctgaaggcacagattccaataccatgccagaggttgaggacactggtgcttgaagggaaactggcacactctggagccccaagaagagctggagctggaggcatgcggcccacgaagggtagaagtaccagccatgaccaagagcccttcacatcatctggcaatccatccagaacccactgaatggaggacagcacagcgaggtctttctcattttgtaactgcaaaagctggaacaagagccagagaagccaaagaagcagtacaagtccaacagcttttagaataaccctgagaaaatggttgaattttgaccagttttgcaattggatactatgagaagagaccttccctcctgcactggatttcatcatcatacctggaggccattcctcatgggactttggccatctcatatccacctttaagcatgttattcccatttcagctgtggtagctctgggtatccttccctaggagaaaatattaatcttttctccctctgagttctggattaaactgtcttatctgaaactgggtcactttaggctagaagcaccactagacattcctgttctcagaagttgccaagttcatgtcatatctgtttcattgttaacgggatccacttctgcaagaggctgcctggccagatcagtgtgtctcctggtcagctccttgatgcccttctcctctcccctgcccaatcccagctgagacttgcactgtggtgactctgtcccctcctggtgctttgactggatgtgtgagagaaagtatggtctgtggcactgacatctttgtgtgtttggaggtgactggaacacggatccacccctggaggaaggtggccgtgaaggaggccagcctcagctcagcgttctactctcatcgctcttactcccgcctttttagtgcctgccctactccaggataattgtgcttttcttttttcagttaaatgttagcattgctatttttcattattgcaaagcagcacatgcttgttacaaaaactttggaagtgtagacaaataaaaagaagaaaaagctacttccaaatcctacttaccccaaagacaagatgatcatttagtcatatagtatcatacatatataatatgtacacatatattttaatgtaagtgtagtgtcacaatatcatgtatagtctttcataaaacacgttggcacttaatatcttatatgaacaactttctagagcaacaagcttagtttacagcaattgtaatgtaagagtactcatttacatagctacagcatcctttgtttacctcatctcttatggtttgatgtttaggttgtttccaacttttctccacctaaacagcattaataaatgtggttttagtttcaaaaaaaaaaaaaaaaaaaaaaaaaaaaaaaaacaagaacaaacaccaacaaaaaaaacacaaaaaaaaacaacaaacacaaaacaacaaacaaaaaaaacgagcaaacacaacaaaaaagtaccaaacaacacaagaaacaagaactaaaaacaccaaccccaccagagaaacaaacaagaaaacaaacgaacaaaaaaaagaggagcaacataaaaaaaaacgaaaccacaagagaacagacaagaaacaaacaaaacaagacaagagagaaaaaaaaaatacagaaaaaaaagaaaaacaaaagacgaaagaaaaaagaaaaacaacgaaagaacagacaacaacatggccaaccaaaaaacagcagacaaaaaaataaagaacacacaaaacgaaaaaaaacacacaagaaaacacaaggacataacaccacacgaaaaaagagaagaaagcacaaaagaaagaaaaaaaaatataagacaacaaaaaca

SEQ ID NO: 307170 - DNA, 2179 bp, Homo sapiens
ccgcgcgcgcacggctctcgcatgccgtggccgggtggctgcagcgctgcgccgcgccgcaccccggatccaagccgctcccgccgcccggccggcgcgcaggtgttcatgaaaaaaatgcacaaaatcctgcctggccggaataattcatgaagaaggggctggatccgtgggtcagagaacacaggaccagtttgccatcccaaggccgaagtctggtgtctcggatttgttcctgtgttgcccactcctgctggatcttgtccagtcgagggacaaacgtcctgaagaatgggaagaaaggaggttctgaaggcacagattccaataccatgccagaggttgaggacactggtgcttgaagggaaactggcacactctggagccccaagaagagctggagctggaggcatgcggcccacgaagggtagaagtaccagccatgaccaagagcccttcacatcatctggcaatccatccagaacccactgaatggaggacagcacagcgaggtctttctcattttgtaactgcaaaagctggaacaagagccagagaagccaaagaagcagtacaagtccaacagcttttagaataaccctgagaaaatggttgaattttgaccagttttgcaattggatactatgagaagagaccttccctcctgcactggatttcatcatcatacctggaggccattcctcatgggactttggccatctcatatccacctttaagcatgttattcccatttcagctgtggtagctctgggtatccttccctaggagaaaatattaatcttttctccctctgagttctggattaaactgtcttatctgaaactgggtcactttaggctagaagcaccactagacattcctgttctcagaagttgccaagttcatgtcatatctgtttcattgttaacgggatccacttctgcaagaggctgcctggccagatcagtgtgtctcctggtcagctccttgatgcccttctcctctcccctgcccaatcccagctgagacttgcactgtggtgactctgtcccctcctggtgctttgactggatgtgtgagagaaagtatggtctgtggcactgacatctttgtgtgtttggaggtgactggaacacggatccacccctggaggaaggtggccgtgaaggaggccagcctcagctcagcgttctactctcatcgctcttactcccgcctttttagtgcctgccctactccaggataattgtgcttttcttttttcagttaaatgttagcattgctatttttcattattgcaaagcagcacatgcttgttacaaaaactttggaagtgtagacaaataaaaagaagaaaaagctacttccaaatcctacttaccccaaagacaagatgatcatttagtcatatagtatcatacatatataatatgtacacatatattttaatgtaagtgtagtgtcacaatatcatgtatagtctttcataaaacacgttggcacttaatatcttatatgaacaactttctagagcaacaagcttagtttacagcaattgtaatgtaagagtactcatttacatagctacagcatcctttgtttacctcatctcttatggtttgatgtttaggttgtttccaacttttctccacctaaacagcattaataaatgtggttttagtttcaaaaaaaaaaaaaaaaaaaaaaaaaaaaaaaaacaagaacaaacaccaacaaaaaaaacacaaaaaaaaacaacaaacacaaaacaacaaacaaaaaaaacgagcaaacacaacaaaaaagtaccaaacaacacaagaaacaagaactaaaaacaccaaccccaccagagaaacaaacaagaaaacaaacgaacaaaaaaaagaggagcaacataaaaaaaaacgaaaccacaagagaacagacaagaaacaaacaaaacaagacaagagagaaaaaaaaaatacagaaaaaaaagaaaaacaaaagacgaaagaaaaaagaaaaacaacgaaagaacagacaacaacatggccaaccaaaaaacagcagacaaaaaaataaagaacacacaaaacgaaaaaaaacacacaagaaaacacaaggacataacaccacacgaaaaaagagaagaaagcacaaaagaaagaaaaaaaaatataagacaacaaaaaca

SEQ ID NO: 307171 - DNA, 2234 bp, Homo sapiens
ttggagtctttgtgaacctgctgtgattctgggggctgcctgatttgattatagaacacatgtgctccttaaagaaaaacactgtgcatggagataacagtcatcaaacatggaaacctttgagttgaatagctcatccagtttccccacattatttccagtggaggacccagcactcagagacgcccttctttaaagaagcagtttatccattctgcatatccagaggttctcctcatgactcagagcccctctgagaagagaaacagtctggtgtctcggatttgttcctgtgttgcccactcctgctggatcttgtccagtcgagggacaaacgtcctgaagaatgggaagaaaggaggttctgaaggcacagattccaataccatgccagaggttgaggacactggtgcttgaagggaaactggcacactctggagccccaagaagagctggagctggaggcatgcggcccacgaagggtagaagtaccagccatgaccaagagcccttcacatcatctggcaatccatccagaacccactgaatggaggacagcacagcgaggtctttctcattttgtaactgcaaaagctggaacaagagccagagaagccaaagaagcagtacaagtccaacagcttttagaataaccctgagaaaatggttgaattttgaccagttttgcaattggatactatgagaagagaccttccctcctgcactggatttcatcatcatacctggaggccattcctcatgggactttggccatctcatatccacctttaagcatgttattcccatttcagctgtggtagctctgggtatccttccctaggagaaaatattaatcttttctccctctgagttctggattaaactgtcttatctgaaactgggtcactttaggctagaagcaccactagacattcctgttctcagaagttgccaagttcatgtcatatctgtttcattgttaacgggatccacttctgcaagaggctgcctggccagatcagtgtgtctcctggtcagctccttgatgcccttctcctctcccctgcccaatcccagctgagacttgcactgtggtgactctgtcccctcctggtgctttgactggatgtgtgagagaaagtatggtctgtggcactgacatctttgtgtgtttggaggtgactggaacacggatccacccctggaggaaggtggccgtgaaggaggccagcctcagctcagcgttctactctcatcgctcttactcccgcctttttagtgcctgccctactccaggataattgtgcttttcttttttcagttaaatgttagcattgctatttttcattattgcaaagcagcacatgcttgttacaaaaactttggaagtgtagacaaataaaaagaagaaaaagctacttccaaatcctacttaccccaaagacaagatgatcatttagtcatatagtatcatacatatataatatgtacacatatattttaatgtaagtgtagtgtcacaatatcatgtatagtctttcataaaacacgttggcacttaatatcttatatgaacaactttctagagcaacaagcttagtttacagcaattgtaatgtaagagtactcatttacatagctacagcatcctttgtttacctcatctcttatggtttgatgtttaggttgtttccaacttttctccacctaaacagcattaataaatgtggttttagtttcaaaaaaaaaaaaaaaaaaaaaaaaaaaaaaaaacaagaacaaacaccaacaaaaaaaacacaaaaaaaaacaacaaacacaaaacaacaaacaaaaaaaacgagcaaacacaacaaaaaagtaccaaacaacacaagaaacaagaactaaaaacaccaaccccaccagagaaacaaacaagaaaacaaacgaacaaaaaaaagaggagcaacataaaaaaaaacgaaaccacaagagaacagacaagaaacaaacaaaacaagacaagagagaaaaaaaaaatacagaaaaaaaagaaaaacaaaagacgaaagaaaaaagaaaaacaacgaaagaacagacaacaacatggccaaccaaaaaacagcagacaaaaaaataaagaacacacaaaacgaaaaaaaacacacaagaaaacacaaggacataacaccacacgaaaaaagagaagaaagcacaaaagaaagaaaaaaaaatataagacaacaaaaaca

SEQ ID NO: 307172 - DNA, 586 bp, Homo sapiens
tacctaggaattcacaagctgtattccaatctagagttccctggtcatttcttactttgcttcaaaataattctcatctctgcagagctcatccagtttccccacattatttccagtggaggacccagcactcagagacgcccttctttaaaggtaaccagaggaaacagcgataatgccaggacccaagagtgtgtctgtgtcttccatcagcctgcagtgtgggatgtgacagctccccagagcatattctgaggggaggggctagatgacaggggtggctgtacttctgtgagacctcaggattcatggattcagccccagctgcccctgctatcaccgccagaggtggcaaatggcatttgacaggtgggctgcacagtgggtccagctcattggtgatgccccttggtaggaccagatctcctgtctgtcccatctgatccttattgctcctaatctttgtttagccccagctgctgttgtggctgtgactattataaaagatggcgtgaacgatgatatgaggaagggctttaattttgctggctaccaaggagagagtgaataaaaaaaatagatccaa

SEQ ID NO: 307173 - DNA, 391 bp, Homo sapiens
attgcttttgttttcatgcatgccctaaggtcacagagatgggggataacagtatgatgggagattctggtagggactcaaacctgatggtgttcagtagttgcaggtagactgctgctaaaagttggactttcaatttagaataaaataatgggtcaatgtatattatgtacattttctccatttcctgagtttagctttcaacagttaagatacttgcaacagcagaagtaacactacatagtgttacagtgtacaaatcccttgtcatttttattttaaaatatatttattacctcagtctctggctatattcacatagcgcaagggcacaagatcatcccttctgtttctctctctaaagctgagtaggttctgagtgaactgacag

SEQ ID NO: 307174 - DNA, 4073 bp, Homo sapiens
ggcactggccgccccaagggtaaagctgatggaggacccataccaacgcccagagttgcagttcttccccctgaggaagggaccctgggcagccggagagctcattgccgcctttcaactcattgaactagactacagtggccgacttgaggtcagcatgccctggcgtggctagcacaggctgtgagcccaacttgttagtccatcaggccatccagccctagggaatataaaacatggatatgtcccaggaccagcctccaggtctcttttccccagagaataaagactgcaggtttgtcctgaggtcacctcattggaccacttgaccccaaggaacattgcaagtattcatgtgctaggttcaccttgttgggccatcctgcatgcctcagacaccctgctcccttcctgcacgaagctgcttcccgagaccccctcccttccaccaatccagccttggttggttcctgtgcatttacatttcaccagtacctctccatatcccctccccacacctaggcttttcctcctttggcctgattcctcttcgccctctgactgtttccctcctacagccctcagtgcccagtgatgtggagccccaggatctggcacccctggttgagccccactctggacgcctgtcccttccacccaacgtgtgcccagtgctcagggagttccgtgttgaggtgctgttctggggtcttaggggacttggtcgtgtgcatctgctcgaggtggagcagccccaggttgtactggaggtggctgggcaacgtgtggagtctgaggtcctggccagctaccgtgagagccccaatttcactgagcttgtcaggcatcttcttagacttgccggagcagccttacttgcagcctccactcagcatcttggtgattgagcgccgggcctttggccacacagtccttgtgggttcccacattgtcccccacatgctgcgattcacatttcggggtcatgaggatcctcctgaggaggaaggagagatggaggagacaggggatatgatgcccaagggacctcaaggacagaagtccctggatcccttcttggctgaagcgggtatatccagacagctcctgaagcctcctctgaagaagctcccactaggaggcctcctaaatcaaggccctgggctggaggaagacatcccagatccagaggagctcgactgggggtccaagtactatgcgtcgctgcaggagctccaggggcagcacaactttgatgaagatgaaatggatgatcctggagattcagatggggtcaacctcatttctatggttggggagatccaagaccagggtgaggctgaagtcaaaggcactgtgtccccaaaaaaagcagttgccaccctgaagatctacaacaggtccctggaggaagaatttaaccactttgaagactggctgaatgtgtttcctctgtaccgagggcaagggggccaggatggaggtggagaagaggaaggatctggacaccttgtgggcaagttcaagggctccttcctcatttaccctgaatcagaggcagtgttgttctctgagccccagatctcccgggggatcccacagaaccggcccatcaagctcctggtcagagtgtatgttgtaaaggctaccaacctggctcctgcagaccccaatggcaaagcagacccttacgtggtggtgagcgctggccgggagcggcaggacaccaaggaacgctacatccccaagcagctcaaccccatctttggagagatcctggagctaagcatctctctcccagctgagacggagctgacggtcgccgtatttgaacatgacctcgtgggttctgacgacctcatcggggagacccacattgatctggaaaaccgattctatagccaccacagagcaaactgtgggctggcctcccagtatgaagtgtgggtccagcagggcccacaggagccattctgagtttctggccaaacacattcaagctcacattcccttttgtgtctccagatcctatgatttcatggaaggggaccctcccacccaccgccactgccaaccaagacatagctcagtggtcaagacttgggcttgggagtcgggatcctgtaacgaatgtcacttgaccgctttctttttttatgaaacagtctcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatattttcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatatttttagtagagacagggtttcaccatgttgtccaggctggtcttgaacccctgacctcaagtgatccacccacctctgcctcccaaagtgctgggattacaggtgtgagccaccatgccaggccctcttaacctcttcaagtctgttttctcatctgcaaaacagaggtaataagatcagtatcttcttaatggaagcacctggactacatttttttcattcattgttatcataaatgaggactaacctgtctcccgttgggagttttgaacctagacctcatgtcttcatgacgtcatcactgccccaggcccagctgtgtccctacaccagccccagctgacgcatcttctttttctgcctgtagagatggttacaatgcctggcgtgatgcattctggccttcgcagatcctggcggggctgtgccaacgctgtggcctccctgcccctgaataccgagccggtgctgtcaaggtgggcagcaaagtcttcctgacaccaccggagaccctgcccccagggatctcttcacatgtggattgacatctttcctcaagatgtgcctgctccacccccagttgacatcaagcctcggcagccaatcagctatgagctcagagttgtcatctggaacacggaggatgtggttctggatgacgagaatccactcaccggagagatgtcgagtgacatctatgtgaagagctgggtgaaggggttggagcatgacaagcaggagacagacgttcacttcaactccctgactggggaggggaacttcaattggcgctttgtgttccgctttgactacctgcccacggagcgggaggtgagcgtctggcgcaggtctggaccctttgccctggaggaggcggagttccggcagcctgcagtgctggtcctgcaggatccctggagttgcagctaccagacatggtgcgtggggcccggggccccgagctctgctctgtgcagctggcccgcaatggggccgggccgaggtgcaatctgtttcgctgccgccgcctgaggggctggtggccggtagtgaagctgaaggaggcagaggacgtggagcgggaggcgcaggaggctcaggctggcaagaagaagcgaaagcagaggaggaggaagggccggccagaagacctggagttcacagacatgggtggcaatgtgtacatcctcacgggcaaggtggaggcagagtttgagctgctgactgtggaggaggccgagaaacggccagtggggaaggggcggaagcagccagagcctctggagaaacccagccgccccaaaacttccttcaactggtttgtgaacccgctgaagacctttgtcttcttcatctggcgccggtactggcgcaccctggtgctgctgctactggtgctgctcaccgtcttcctcctcctggtcttctacaccatccctggccagatcagccaggtcatcttccgtcccctccacaagtgactctcgctgaccttggacactcacccagggtgccaacccttcaatgcctgctcctggaagtctttcttacccatgtgagctaccccagagtctagtgcttcctctgaataaacctatcacagccactga

SEQ ID NO: 307175 - DNA, 3646 bp, Homo sapiens
ggcactggccgccccaagggtaaagctgatggaggacccataccaacgcccagagttgcagttcttccccctgaggaagggaccctgggcagccggagagctcattgccgcctttcaactcattgaactagactacagtggccgacttgagccctcagtgcccagtgatgtggagccccaggatctggcacccctggttgagccccactctggacgcctgtcccttccacccaacgtgtgcccagtgctcagggagttccgtgttgaggtgctgttctggggtcttaggggacttggtcgtgtgcatctgctcgaggtggagcagccccaggttgtactggaggtggctgggcaacgtgtggagtctgaggtcctggccagctaccgtgagagccccaatttcactgagcttgtcaggcatcttcttagacttgccggagcagccttacttgcagcctccactcagcatcttggtgattgagcgccgggcctttggccacacagtccttgtgggttcccacattgtcccccacatgctgcgattcacatttcggggtcatgaggatcctcctgaggaggaaggagagatggaggagacaggggatatgatgcccaagggacctcaaggacagaagtccctggatcccttcttggctgaagcgggtatatccagacagctcctgaagcctcctctgaagaagctcccactaggaggcctcctaaatcaaggccctgggctggaggaagacatcccagatccagaggagctcgactgggggtccaagtactatgcgtcgctgcaggagctccaggggcagcacaactttgatgaagatgaaatggatgatcctggagattcagatggggtcaacctcatttctatggttggggagatccaagaccagggtgaggctgaagtcaaaggcactgtgtccccaaaaaaagcagttgccaccctgaagatctacaacaggtccctggaggaagaatttaaccactttgaagactggctgaatgtgtttcctctgtaccgagggcaagggggccaggatggaggtggagaagaggaaggatctggacaccttgtgggcaagttcaagggctccttcctcatttaccctgaatcagaggcagtgttgttctctgagccccagatctcccgggggatcccacagaaccggcccatcaagctcctggtcagagtgtatgttgtaaaggctaccaacctggctcctgcagaccccaatggcaaagcagacccttacgtggtggtgagcgctggccgggagcggcaggacaccaaggaacgctacatccccaagcagctcaaccccatctttggagagatcctggagctaagcatctctctcccagctgagacggagctgacggtcgccgtatttgaacatgacctcgtgggttctgacgacctcatcggggagacccacattgatctggaaaaccgattctatagccaccacagagcaaactgtgggctggcctcccagtatgaagtgtgggtccagcagggcccacaggagccattctgagtttctggccaaacacattcaagctcacattcccttttgtgtctccagatcctatgatttcatggaaggggaccctcccacccaccgccactgccaaccaagacatagctcagtggtcaagacttgggcttgggagtcgggatcctgtaacgaatgtcacttgaccgctttctttttttatgaaacagtctcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatattttcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatatttttagtagagacagggtttcaccatgttgtccaggctggtcttgaacccctgacctcaagtgatccacccacctctgcctcccaaagtgctgggattacaggtgtgagccaccatgccaggccctcttaacctcttcaagtctgttttctcatctgcaaaacagaggtaataagatcagtatcttcttaatggaagcacctggactacatttttttcattcattgttatcataaatgaggactaacctgtctcccgttgggagttttgaacctagacctcatgtcttcatgacgtcatcactgccccaggcccagctgtgtccctacaccagccccagctgacgcatcttctttttctgcctgtagagatggttacaatgcctggcgtgatgcattctggccttcgcagatcctggcggggctgtgccaacgctgtggcctccctgcccctgaataccgagccggtgctgtcaaggtgggcagcaaagtcttcctgacaccaccggagaccctgcccccagggatctcttcacatgtggattgacatctttcctcaagatgtgcctgctccacccccagttgacatcaagcctcggcagccaatcagctatgagctcagagttgtcatctggaacacggaggatgtggttctggatgacgagaatccactcaccggagagatgtcgagtgacatctatgtgaagagctgggtgaaggggttggagcatgacaagcaggagacagacgttcacttcaactccctgactggggaggggaacttcaattggcgctttgtgttccgctttgactacctgcccacggagcgggaggtgagcgtctggcgcaggtctggaccctttgccctggaggaggcggagttccggcagcctgcagtgctggtcctgcaggatccctggagttgcagctaccagacatggtgcgtggggcccggggccccgagctctgctctgtgcagctggcccgcaatggggccgggccgaggtgcaatctgtttcgctgccgccgcctgaggggctggtggccggtagtgaagctgaaggaggcagaggacgtggagcgggaggcgcaggaggctcaggctggcaagaagaagcgaaagcagaggaggaggaagggccggccagaagacctggagttcacagacatgggtggcaatgtgtacatcctcacgggcaaggtggaggcagagtttgagctgctgactgtggaggaggccgagaaacggccagtggggaaggggcggaagcagccagagcctctggagaaacccagccgccccaaaacttccttcaactggtttgtgaacccgctgaagacctttgtcttcttcatctggcgccggtactggcgcaccctggtgctgctgctactggtgctgctcaccgtcttcctcctcctggtcttctacaccatccctggccagatcagccaggtcatcttccgtcccctccacaagtgactctcgctgaccttggacactcacccagggtgccaacccttcaatgcctgctcctggaagtctttcttacccatgtgagctaccccagagtctagtgcttcctctgaataaacctatcacagccactga

SEQ ID NO: 307176 - DNA, 4113 bp, Homo sapiens
ggcactggccgccccaagggtaaagctgatggaggacccataccaacgcccagagttgcagttcttccccctgaggaagggaccctgggcagccggagagctcattgccgcctttcaactcattgaactagactacagtggccgacttgaggtcagcatgccctggcgtggctagcacaggctgtgagcccaacttgttagtccatcaggccatccagccctagggaatataaaacatggatatgtcccaggaccagcctccaggtctcttttccccagagaataaagactgcaggtttgtcctgaggtcacctcattggaccacttgaccccaaggaacattgcaagtattcatgtgctaggttcaccttgttgggccatcctgcatgcctcagacaccctgctcccttcctgcacgaagctgcttcccgagaccccctcccttccaccaatccagccttggttggttcctgtgcatttacatttcaccagtacctctccatatcccctccccacacctaggcttttcctcctttggcctgattcctcttcgccctctgactgtttccctcctacagccctcagtgcccagtgatgtggagccccaggatctggcacccctggttgagccccactctggacgcctgtcccttccacccaacgtgtgcccagtgctcagggagttccgtgttgaggtgctgttctggggtcttaggggacttggtcgtgtgcatctgctcgaggtggagcagccccaggttgtactggaggtggctgggcaacgtgtggagtctgaggtcctggccagctaccgtgagagccccaatttcactgagcttgtcaggcatcttcttagacttgccggagcagccttacttgcagcctccactcagcatcttggtgattgagcgccgggcctttggccacacagtccttgtgggttcccacattgtcccccacatgctgcgattcacatttcggggtcatgaggatcctcctgaggaggaaggagagatggaggagacaggggatatgatgcccaagggacctcaaggacagaagtccctggatcccttcttggctgaagcgggtatatccagacagctcctgaagcctcctctgaagaagctcccactaggaggcctcctaaatcaaggccctgggctggaggaagacatcccagatccagaggagctcgactgggggtccaagtactatgcgtcgctgcaggagctccaggggcagcacaactttgatgaagatgaaatggatgatcctggagattcagatggggtcaacctcatttctatggttggggagatccaagaccagggtgaggctgaagtcaaaggcactgtgtccccaaaaaaagcagttgccaccctgaagatctacaacaggtccctggaggaagaatttaaccactttgaagactggctgaatgtgtttcctctgtaccgagggcaagggggccaggatggaggtggagaagaggaaggatctggacaccttgtgggcaagttcaagggctccttcctcatttaccctgaatcagaggcagtgttgttctctgagccccagatctcccgggggatcccacagaaccggcccatcaagctcctggtcagagtgtatgttgtaaaggctaccaacctggctcctgcagaccccaatggcaaagcagacccttacgtggtggtgagcgctggccgggagcggcaggacaccaaggaacgctacatccccaagcagctcaaccccatctttggagagatcctggagctaagcatctctctcccagctgagacggagctgacggtcgccgtatttgaacatgacctcgtgggttctgacgacctcatcggggagacccacattgatctggaaaaccgattctatagccaccacagagcaaactgtgggctggcctcccagtatgaagtgtgggtccagcagggcccacaggagccattctgagtttctggccaaacacattcaagctcacattcccttttgtgtctccagatcctatgatttcatggaaggggaccctcccacccaccgccactgccaaccaagacatagctcagtggtcaagacttgggcttgggagtcgggatcctgtaacgaatgtcacttgaccgctttctttttttatgaaacagtctcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatattttcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatatttttagtagagacagggtttcaccatgttgtccaggctggtcttgaacccctgacctcaagtgatccacccacctctgcctcccaaagtgctgggattacaggtgtgagccaccatgccaggccctcttaacctcttcaagtctgttttctcatctgcaaaacagaggtaataagatcagtatcttcttaatggaagcacctggactacatttttttcattcattgttatcataaatgaggactaacctgtctcccgttgggagttttgaacctagacctcatgtcttcatgacgtcatcactgccccaggcccagctgtgtccctacaccagccccagctgacgcatcttctttttctgcctgtagagatggttacaatgcctggcgtgatgcattctggccttcgcagatcctggcggggctgtgccaacgctgtggcctccctgcccctgaataccgagccggtgctgtcaaggtgggcagcaaagtcttcctgacaccaccggagaccctgcccccagggatctcttcacatgtggattgacatctttcctcaagatgtgcctgctccacccccagttgacatcaagcctcggcagccaatcagctatgagctcagagttgtcatctggaacacggaggatgtggttctggatgacgagaatccactcaccggagagatgtcgagtgacatctatgtgaagagctgggtgaaggggttggagcatgacaagcaggagacagacgttcacttcaactccctgactggggaggggaacttcaattggcgctttgtgttccgctttgactacctgcccacggagcgggaggtgagcgtctggcgcaggtctggaccctttgccctggaggaggcggagttccggcagcctgcagtgctggtcctgcaggtctgggactatgaccgcatctctgccaatgacttccttggatccctggagttgcagctaccagacatggtgcgtggggcccggggccccgagctctgctctgtgcagctggcccgcaatggggccgggccgaggtgcaatctgtttcgctgccgccgcctgaggggctggtggccggtagtgaagctgaaggaggcagaggacgtggagcgggaggcgcaggaggctcaggctggcaagaagaagcgaaagcagaggaggaggaagggccggccagaagacctggagttcacagacatgggtggcaatgtgtacatcctcacgggcaaggtggaggcagagtttgagctgctgactgtggaggaggccgagaaacggccagtggggaaggggcggaagcagccagagcctctggagaaacccagccgccccaaaacttccttcaactggtttgtgaacccgctgaagacctttgtcttcttcatctggcgccggtactggcgcaccctggtgctgctgctactggtgctgctcaccgtcttcctcctcctggtcttctacaccatccctggccagatcagccaggtcatcttccgtcccctccacaagtgactctcgctgaccttggacactcacccagggtgccaacccttcaatgcctgctcctggaagtctttcttacccatgtgagctaccccagagtctagtgcttcctctgaataaacctatcacagccactga

SEQ ID NO: 307177 - DNA, 3981 bp, Homo sapiens
ggcactggccgccccaagggtaaagctgatggaggacccataccaacgcccagagttgcagttcttccccctgaggaagggaccctgggcagccggagagctcattgccgcctttcaactcattgaactagactacagtggccgacttgaggtcagcatgccctggcgtggctagcacaggctgtgagcccaacttgttagtccatcaggccatccagccctagggaatataaaacatggatatgtcccaggaccagcctccaggtctcttttccccagagaataaagactgcaggtttgtcctgaggtcacctcattggaccacttgaccccaaggaacattgcaagtattcatgtgctaggttcaccttgttgggccatcctgcatgcctcagacaccctgctcccttcctgcacgaagctgcttcccgagaccccctcccttccaccaatccagccttggttggttcctgtgcatttacatttcaccagtacctctccatatcccctccccacacctaggcttttcctcctttggcctgattcctcttcgccctctgactgtttccctcctacagccctcagtgcccagtgatgtggagccccaggatctggcacccctggttgagccccactctggacgcctgtcccttccacccaacgtgtgcccagtgctcagggagttccgtgttgaggtgctgttctggggtcttaggggacttggtcgtgtgcatctgctcgaggtggagcagccccaggttgtactggaggtggctgggcaacgtgtggagtctgaggtcctggccagctaccgtgagagccccaatttcactgagcttgtcaggcatcttcttagacttgccggagcagccttacttgcagcctccactcagcatcttggtgattgagcgccgggcctttggccacacagtccttgtgggttcccacattgtcccccacatgctgcgattcacatttcggggtcatgaggatcctcctgaggaggaaggagagatggaggagacaggggatatgatgcccaagggacctcaaggacagaagtccctggatcccttcttggctgaagcgggtatatccagacagctcctgaagcacaactttgatgaagatgaaatggatgatcctggagattcagatggggtcaacctcatttctatggttggggagatccaagaccagggtgaggctgaagtcaaaggcactgtgtccccaaaaaaagcagttgccaccctgaagatctacaacaggtccctggaggaagaatttaaccactttgaagactggctgaatgtgtttcctctgtaccgagggcaagggggccaggatggaggtggagaagaggaaggatctggacaccttgtgggcaagttcaagggctccttcctcatttaccctgaatcagaggcagtgttgttctctgagccccagatctcccgggggatcccacagaaccggcccatcaagctcctggtcagagtgtatgttgtaaaggctaccaacctggctcctgcagaccccaatggcaaagcagacccttacgtggtggtgagcgctggccgggagcggcaggacaccaaggaacgctacatccccaagcagctcaaccccatctttggagagatcctggagctaagcatctctctcccagctgagacggagctgacggtcgccgtatttgaacatgacctcgtgggttctgacgacctcatcggggagacccacattgatctggaaaaccgattctatagccaccacagagcaaactgtgggctggcctcccagtatgaagtgtgggtccagcagggcccacaggagccattctgagtttctggccaaacacattcaagctcacattcccttttgtgtctccagatcctatgatttcatggaaggggaccctcccacccaccgccactgccaaccaagacatagctcagtggtcaagacttgggcttgggagtcgggatcctgtaacgaatgtcacttgaccgctttctttttttatgaaacagtctcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatattttcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatatttttagtagagacagggtttcaccatgttgtccaggctggtcttgaacccctgacctcaagtgatccacccacctctgcctcccaaagtgctgggattacaggtgtgagccaccatgccaggccctcttaacctcttcaagtctgttttctcatctgcaaaacagaggtaataagatcagtatcttcttaatggaagcacctggactacatttttttcattcattgttatcataaatgaggactaacctgtctcccgttgggagttttgaacctagacctcatgtcttcatgacgtcatcactgccccaggcccagctgtgtccctacaccagccccagctgacgcatcttctttttctgcctgtagagatggttacaatgcctggcgtgatgcattctggccttcgcagatcctggcggggctgtgccaacgctgtggcctccctgcccctgaataccgagccggtgctgtcaaggtgggcagcaaagtcttcctgacaccaccggagaccctgcccccagggatctcttcacatgtggattgacatctttcctcaagatgtgcctgctccacccccagttgacatcaagcctcggcagccaatcagctatgagctcagagttgtcatctggaacacggaggatgtggttctggatgacgagaatccactcaccggagagatgtcgagtgacatctatgtgaagagctgggtgaaggggttggagcatgacaagcaggagacagacgttcacttcaactccctgactggggaggggaacttcaattggcgctttgtgttccgctttgactacctgcccacggagcgggaggtgagcgtctggcgcaggtctggaccctttgccctggaggaggcggagttccggcagcctgcagtgctggtcctgcaggtctgggactatgaccgcatctctgccaatgacttccttggatccctggagttgcagctaccagacatggtgcgtggggcccggggccccgagctctgctctgtgcagctggcccgcaatggggccgggccgaggtgcaatctgtttcgctgccgccgcctgaggggctggtggccggtagtgaagctgaaggaggcagaggacgtggagcgggaggcgcaggaggctcaggctggcaagaagaagcgaaagcagaggaggaggaagggccggccagaagacctggagttcacagacatgggtggcaatgtgtacatcctcacgggcaaggtggaggcagagtttgagctgctgactgtggaggaggccgagaaacggccagtggggaaggggcggaagcagccagagcctctggagaaacccagccgccccaaaacttccttcaactggtttgtgaacccgctgaagacctttgtcttcttcatctggcgccggtactggcgcaccctggtgctgctgctactggtgctgctcaccgtcttcctcctcctggtcttctacaccatccctggccagatcagccaggtcatcttccgtcccctccacaagtgactctcgctgaccttggacactcacccagggtgccaacccttcaatgcctgctcctggaagtctttcttacccatgtgagctaccccagagtctagtgcttcctctgaataaacctatcacagccactga

SEQ ID NO: 307178 - DNA, 2792 bp, Homo sapiens
tactgggaagaggaaagtctcctttggattctggacatcgggctgttgctgaagtccttgccttttagatctacaacaggtccctggaggaagaatttaaccactttgaagactggctgaatgtgtttcctctgtaccgagggcaagggggccaggatggaggtggagaagaggaaggatctggacaccttgtgggcaagttcaagggctccttcctcatttaccctgaatcagaggcagtgttgttctctgagccccagatctcccgggggatcccacagaaccggcccatcaagctcctggtcagagtgtatgttgtaaaggctaccaacctggctcctgcagaccccaatggcaaagcagacccttacgtggtggtgagcgctggccgggagcggcaggacaccaaggaacgctacatccccaagcagctcaaccccatctttggagagatcctggagctaagcatctctctcccagctgagacggagctgacggtcgccgtatttgaacatgacctcgtgggttctgacgacctcatcggggagacccacattgatctggaaaaccgattctatagccaccacagagcaaactgtgggctggcctcccagtatgaagtgtgggtccagcagggcccacaggagccattctgagtttctggccaaacacattcaagctcacattcccttttgtgtctccagatcctatgatttcatggaaggggaccctcccacccaccgccactgccaaccaagacatagctcagtggtcaagacttgggcttgggagtcgggatcctgtaacgaatgtcacttgaccgctttctttttttatgaaacagtctcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatattttcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatatttttagtagagacagggtttcaccatgttgtccaggctggtcttgaacccctgacctcaagtgatccacccacctctgcctcccaaagtgctgggattacaggtgtgagccaccatgccaggccctcttaacctcttcaagtctgttttctcatctgcaaaacagaggtaataagatcagtatcttcttaatggaagcacctggactacatttttttcattcattgttatcataaatgaggactaacctgtctcccgttgggagttttgaacctagacctcatgtcttcatgacgtcatcactgccccaggcccagctgtgtccctacaccagccccagctgacgcatcttctttttctgcctgtagagatggttacaatgcctggcgtgatgcattctggccttcgcagatcctggcggggctgtgccaacgctgtggcctccctgcccctgaataccgagccggtgctgtcaaggtgggcagcaaagtcttcctgacaccaccggagaccctgcccccagggatctcttcacatgtggattgacatctttcctcaagatgtgcctgctccacccccagttgacatcaagcctcggcagccaatcagctatgagctcagagttgtcatctggaacacggaggatgtggttctggatgacgagaatccactcaccggagagatgtcgagtgacatctatgtgaagagctgggtgaaggggttggagcatgacaagcaggagacagacgttcacttcaactccctgactggggaggggaacttcaattggcgctttgtgttccgctttgactacctgcccacggagcgggaggtgagcgtctggcgcaggtctggaccctttgccctggaggaggcggagttccggcagcctgcagtgctggtcctgcaggtctgggactatgaccgcatctctgccaatgacttccttggatccctggagttgcagctaccagacatggtgcgtggggcccggggccccgagctctgctctgtgcagctggcccgcaatggggccgggccgaggtgcaatctgtttcgctgccgccgcctgaggggctggtggccggtagtgaagctgaaggaggcagaggacgtggagcgggaggcgcaggaggctcaggctggcaagaagaagcgaaagcagaggaggaggaagggccggccagaagacctggagttcacagacatgggtggcaatgtgtacatcctcacgggcaaggtggaggcagagtttgagctgctgactgtggaggaggccgagaaacggccagtggggaaggggcggaagcagccagagcctctggagaaacccagccgccccaaaacttccttcaactggtttgtgaacccgctgaagacctttgtcttcttcatctggcgccggtactggcgcaccctggtgctgctgctactggtgctgctcaccgtcttcctcctcctggtcttctacaccatccctggccagatcagccaggtcatcttccgtcccctccacaagtgactctcgctgaccttggacactcacccagggtgccaacccttcaatgcctgctcctggaagtctttcttacccatgtgagctaccccagagtctagtgcttcctctgaataaacctatcacagccactga

SEQ ID NO: 307179 - DNA, 3952 bp, Homo sapiens
ggcactggccgccccaagggtaaagctgatggaggacccataccaacgcccagagttgcagttcttccccctgaggaagggaccctgggcagccggagagctcattgccgcctttcaactcattgaactagactacagtggccgacttgaggtcagcatgccctggcgtggctagcacaggctgtgagcccaacttgttagtccatcaggccatccagccctagggaatataaaacatggatatgtcccaggaccagcctccaggtctcttttccccagagaataaagactgcaggtttgtcctgaggtcacctcattggaccacttgaccccaaggaacattgcaagtattcatgtgctaggttcaccttgttgggccatcctgcatgcctcagacaccctgctcccttcctgcacgaagctgcttcccgagaccccctcccttccaccaatccagccttggttggttcctgtgcatttacatttcaccagtacctctccatatcccctccccacacctaggcttttcctcctttggcctgattcctcttcgccctctgactgtttccctcctacagccctcagtgcccagtgatgtggagccccaggatctggcacccctggttgagccccactctggacgcctgtcccttccacccaacgtgtgcccagtgctcagggagttccgtgttgaggtgctgttctggggtcttaggggacttggtcgtgtgcatctgctcgaggtggagcagccccaggttgtactggaggtggctgggcaacgtgtggagtctgaggtcctggccagctaccgtgagagccccaatttcactgagcttgtcaggcatcttcttagacttgccggagcagccttacttgcagcctccactcagcatcttggtgattgagcgccgggcctttggccacacagtccttgtgggttcccacattgtcccccacatgctgcgattcacatttcggggtcatgaggatcctcctgaggaggaaggagagatggaggagacaggggatatgatgcccaagggacctcaaggacagaagtccctggatcccttcttggctgaagcgggtatatccagacagctcctgaagcctcctctgaagaagctcccactaggaggcctcctaaatcaaggccctgggctggaggaagacatcccagatccagaggagctcgactgggggtccaagtactatgcgtcgctgcaggagctccaggggcagcacaactttgatgaagatgaaatggatgatcctggagattcagatggggtcaacctcatttctatggttggggagatccaagaccagggtgaggctgaagtcaaaggcactgtgtccccaaaaaaagcagttgccaccctgaagatctacaacaggtccctggaggaagaatttaaccactttgaagactggctgaatgtgtttcctctgtaccgagggcaagggggccaggatggaggtggagaagaggaaggatctggacaccttgtgggcaagttcaagggctccttcctcatttaccctgaatcagaggcagtgttgttctctgagccccagatctcccgggggatcccacagaaccggcccatcaagctcctggtcagagtgtatgttgtaaaggctaccaacctggctcctgcagaccccaatggcaaagcagacccttacgtggtggtgagcgctggccgggagcggcaggacaccaaggaacgctacatccccaagcagctcaaccccatctttggagagatcctggagctaagcatctctctcccagctgagacggagctgacggtcgccgtatttgaacatgacctcgtgggttctgacgacctcatcggggagacccacattgatctggaaaaccgattctatagccaccacagagcaaactgtgggctggcctcccagtatgaagtgtgggtccagcagggcccacaggagccattctgagtttctggccaaacacattcaagctcacattcccttttgtgtctccagatcctatgatttcatggaaggggaccctcccacccaccgccactgccaaccaagacatagctcagtggtcaagacttgggcttgggagtcgggatcctgtaacgaatgtcacttgaccgctttctttttttatgaaacagtctcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatattttcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatatttttagtagagacagggtttcaccatgttgtccaggctggtcttgaacccctgacctcaagtgatccacccacctctgcctcccaaagtgctgggattacaggtgtgagccaccatgccaggccctcttaacctcttcaagtctgttttctcatctgcaaaacagaggtaataagatcagtatcttcttaatggaagcacctggactacatttttttcattcattgttatcataaatgaggactaacctgtctcccgttgggagttttgaacctagacctcatgtcttcatgacgtcatcactgccccaggcccagctgtgtccctacaccagccccagctgacgcatcttctttttctgcctgtagagatggttacaatgcctggcgtgatgcattctggccttcgcagatcctggcggggctgtgccaacgctgtggcctccctgcccctgaataccgagccggtgctgtcaaggtgggcagcaaagtcttcctgacaccaccggagaccctgcccccagggatctcttcacatgtggattgacatctttcctcaagatgtgcctgctccacccccagttgacatcaagcctcggcagccaatcagctatgagctcagagttgtcatctggaacacggaggatgtggttctggatgacgagaatccactcaccggagagatgtcgagtgacatctatgtgaagaggaggtgagcgtctggcgcaggtctggaccctttgccctggaggaggcggagttccggcagcctgcagtgctggtcctgcaggatccctggagttgcagctaccagacatggtgcgtggggcccggggccccgagctctgctctgtgcagctggcccgcaatggggccgggccgaggtgcaatctgtttcgctgccgccgcctgaggggctggtggccggtagtgaagctgaaggaggcagaggacgtggagcgggaggcgcaggaggctcaggctggcaagaagaagcgaaagcagaggaggaggaagggccggccagaagacctggagttcacagacatgggtggcaatgtgtacatcctcacgggcaaggtggaggcagagtttgagctgctgactgtggaggaggccgagaaacggccagtggggaaggggcggaagcagccagagcctctggagaaacccagccgccccaaaacttccttcaactggtttgtgaacccgctgaagacctttgtcttcttcatctggcgccggtactggcgcaccctggtgctgctgctactggtgctgctcaccgtcttcctcctcctggtcttctacaccatccctggccagatcagccaggtcatcttccgtcccctccacaagtgactctcgctgaccttggacactcacccagggtgccaacccttcaatgcctgctcctggaagtctttcttacccatgtgagctaccccagagtctagtgcttcctctgaataaacctatcacagccactga

SEQ ID NO: 307180 - DNA, 1135 bp, Homo sapiens
  misc_feature (58)..(58): n is a, c, g, or t
  misc_feature (61)..(61): n is a, c, g, or t
  misc_feature (68)..(68): n is a, c, g, or t
attcggcacagaactcggggtggagcaggcacatcttgaggaaagatgtgctctccanatnacaccantcaaagccttcggcagaccaatcagctatgagctcagagttgtcatctggaacacggaggatgtggttctggatgacgagaatccactcaccggagagatgtcgagtgacatctatgtgaagagctgggtgaaggggttggagcatgacaagcaggagacagacgttcacttcaactccctgactggggaggggaacttcaattggcgctttgtgttccgctttgactacctgcccacggagcgggaggtgagcgtctggcgcaggtctggaccctttgccctggaggaggcggagttccggcagcctgcagtgctggtcctgcaggtctgggactatgaccgcatctctgccaatgacttccttggatccctggagttgcagctaccagacatggtgcgtggggcccggggccccgagctctgctctgtgcagctggcccgcaatggggccgggccgaggtgcaatctgtttcgctgccgccgcctgaggggctggtggccggtagtgaagctgaaggaggcagaggacgtggagcgggaggcgcaggaggctcaggctggcaagaagaagcgaaagcagaggaggaggaagggccggccagaagacctggagttcacagacatgggtggcaatgtgtacatcctcacgggcaaggtggaggcagagtttgagctgctgactgtggaggaggccgagaaacggccagtggggaaggggcggaagcagccagagcctctggagaaacccagccgccccaaaacttccttcaactggtttgtgaacccgctgaagacctttgtcttcttcatctggcgccggtactggcgcaccctggtgctgctgctactggtgctgctcaccgtcttcctcctcctggtcttctacaccatccctggccagatcagccaggtcatcttccgtcccctccacaagtgactctcgctgaccttggacactcacccagggtgccaacccttcaatgcctgctcctggaagtctttcttacccatgtgagctaccccagagtctagtgcttcctctgaataaacctatcacagccactga

SEQ ID NO: 307181 - DNA, 1200 bp, Homo sapiens
ggcactggccgccccaagggtaaagctgatggaggacccataccaacgcccagagttgcagttcttccccctgaggaagggaccctgggcagccggagagctcattgccgcctttcaactcattgaactagactacagtggccgacttgaggtcagcatgccctggcgtggctagcacaggctgtgagcccaacttgttagtccatcaggccatccagccctagggaatataaaacatggatatgtcccaggaccagcctccaggtctcttttccccagagaataaagactgcaggtttgtcctgaggtcacctcattggaccacttgaccccaaggaacattgcaagtattcatgtgctaggttcaccttgttgggccatcctgcatgcctcagacaccctgctcccttcctgcacgaagctgcttcccgagaccccctcccttccaccaatccagccttggttggttcctgtgcatttacatttcaccagtacctctccatatcccctccccacacctaggcttttcctcctttggcctgattcctcttcgccctctgactgtttccctcctacagccctcagtgcccagtgatgtggagccccaggatctggcacccctggttgagccccactctggacgcctgtcccttccacccaacgtgtgcccagtgctcagggagttccgtgttgaggtgctgttctggggtcttaggggacttggtcgtgtgcatctgctcgaggtggagcagccccaggttgtactggaggtggctgggcaacgtgtggagtctgaggtcctggccagctaccgtgagagccccaatttcactgagcttgtcaggcatcttcttacagcaagtgactgattcctcatgttcatcgcccccatttgggcagaggcttcaggggcatctttctgtttgtggttccctcttaagcataattcaagggagtcaccaagactttgttgaggaagttgctttgtgagtgtgtaatgacagaaaccaaggatctgtacacaaagtcaaagtactaaccgataggaaatgaaatattgcaaaactcaagatactaacatgtgtgtctctccaaaagggaggccaccctaaaaagtaatatgttcctagtcactaaaggtgtctgagaggaagcacagtaattgtttgctggacatttggggcaaggatttccttctta

SEQ ID NO: 307182 - DNA, 1364 bp, Homo sapiens
ggcactggccgccccaagggtaaagctgatggaggacccataccaacgcccagagttgcagttcttccccctgaggaagggaccctgggcagccggagagctcattgccgcctttcaactcattgaactagactacagtggccgacttgaggtcagcatgccctggcgtggctagcacaggctgtgagcccaacttgttagtccatcaggccatccagccctagggaatataaaacatggatatgtcccaggaccagcctccaggtctcttttccccagagaataaagactgcaggtttgtcctgaggtcacctcattggaccacttgaccccaaggaacattgcaagtattcatgtgctaggttcaccttgttgggccatcctgcatgcctcagacaccctgctcccttcctgcacgaagctgcttcccgagaccccctcccttccaccaatccagccttggttggttcctgtgcatttacatttcaccagtacctctccatatcccctccccacacctaggcttttcctcctttggcctgattcctcttcgccctctgactgtttccctcctacagccctcagtgcccagtgatgtggagccccaggatctggcacccctggttgagccccactctggacgcctgtcccttccacccaacgtgtgcccagtgctcagggagttccgtgttgaggtgctgttctggggtcttaggggacttggtcgtgtgcatctgctcgaggtggagcagccccaggttgtactggaggtggctgggcaacgtgtggagtctgaggtcctggccagctaccgtgagagccccaatttcactgagcttgtcaggcatcttcttagacttgccggagcagccttacttgcagcctccactcagcatcttggtgattgagcgccgggcctttggccacacagtccttgtgggttcccacattgtcccccacatgctgcgattcacatttcggggtcatgaggatcctcctgaggaggaaggagagatggaggagacaggggatatgatgcccaagggacctcaaggacagaagtccctggatcccttcttggctgaagcgggtatatccagacagctcctgaagcctcctctgaagaagctcccactaggaggcctcctaaatcaaggccctgggctggaggaagacatcccagatccagaggagctcgactgggggtccaagtactatgcgtcgctgcaggagctccaggggcagagatggggtctttatctgttatccagactggtctcaaactcctgggttcaagtgatcttcccacctcagcctccccagtagctaggaccataagtacataccactacactcagctaatt

SEQ ID NO: 307183 - DNA, 305 bp, Homo sapiens
  misc_feature (1)..(3): n is a, c, g, or t
  misc_feature (5)..(5): n is a, c, g, or t
nnncnctgctttcgtggtactgctgacttcgtggtgctggctgagataggtttattcagaggaagcactagactctggggtagcgtcacatggataagaacgtcttcctcctcctggtcttctacaccatccctggccagatcagccaggtcatcttccgtcccctccacaagtgactctcgctgaccttggacactcacccagggtgccaacccttcaatgcctgctcctggaagtctttcttacccatgtgagctaccccagagtctagtgcttcctctgaataaacctatcacagccactga

SEQ ID NO: 307184 - DNA, 357 bp, Homo sapiens
gtgaggagtgggttctccatgtagctccagccctgacgctcacccaccccggccccagctgggtgaaggggttggagcatgacaagcaggagacagacgttcacttcaactccctgactggggaggggaacttcaattggcgctttgtgttccgctttgactacctgcccacggagcgggaggtgagcgtctggcgcaggtctggaccctttgccctggaggaggcggagttccggcagcctgcagtgctggtcctgcaggtctgggactatgaccgcatctctgccaatgacttccttggtattacaatgcttagccttccccaccctcagcccctgcctccagccctcacctccg

SEQ ID NO: 307185 - DNA, 460 bp, Homo sapiens
caagcaacatcaagtgttcctctcccatatgagtcatcttgaagcaatccacacaacctctgggacctttttaaccccagataatggctcagacacagggagatggaattcacatcaaaggcaaatgtgtaagctgcctggctttgaaacttcatactccacaagagacaggattagttacacaaatcaggaaagcccaggttagatgcagagtatcagtagagtctatagagtcctcccttccttccccataaacggtttcacctagtgacatagtaccatcttaatctgtctcctgtttctttttaaaatatccaaacctccatttgatttgctagattaaactatgtcccattttaatcagaaggtatctgtccattgtgagctcctacatttattctgcttctctaccacaaagtctttgccgtggcctctctattctggtctctttctgtactca

SEQ ID NO: 307186 - DNA, 1332 bp, Homo sapiens
atcaaaaaagcagattgaaattttctttagaaaagattctccatgatttgaattgcattctctttaaactcaccaatgtaatcattttgggaggagggagaacccacttgctttccaaatgggtttatttaaacccacaaactcaagaggttgttgggggaattaggaaaataagggttttcaatgacctacattgctaggtagaggctgtgatccatgggatttcattctaatgaccatgtgaagatgtttgagtcctcctttgcctttcctcagaaagaatccttctaaggcacaaatcccttagatggataatgtaaggtattgttaactcactcatattgagatcatttttagagataccaggttttatgtatcagcactagatggttccaccctcatgggataaaactgcttacaagtattttgaaagaaaaactgaccaaaattcttaaattgttactaaggcaatcatgcacaggtgacgtatgtcttatctgatttgtttttaactccttggtgcccaaagctcagaagggaattccactgccagcaatgaacatacctggaaaagaaagtaagcaatctgggattttttttctgggttagtaaagaatttttgcaataagttttatcagttgattcaaactgatgtgcatcttaatgatcaaatgtgcacattacataaattaagtccactgatacaacttcttacacatgtatctctagtagctctggcaaacccaatatctgacaccactttggactcaagagactcagtaacgtattatcctgtttatttagcttggttttagctgtgttctctctggataacccacttgatgttaggaacattacttctctgcttattccatattaatactgtgttaggtattttaagaagcaagttattaaataagaaaagtcaaagtattaattcttaccttctattatcctatattagcttcaatacatccaaaccaaatggctgttaggtagatttatttttatataagcatgtttattttgatcagatgttttaacttggatttgaaaaaatacatttatgagatgttttataagatgtgtaaatatagaactgtatttattactatagtaaaggttcagtaacattaaggaccatgataatgataataaaccttgtacagtggcatattctttgatttatattgtgtttctctgcccattttctttaaattcattaactgtatatatgtaaatatatagtacttgtaaatagattccaaatttgcttttctattgggtaaaaaataaatttgtaataaaatgtgtgactatgaaacaaaatat

SEQ ID NO: 307187 - DNA, 463 bp, Homo sapiens
agcttgagtgacttgactcaggtcacacagctatttagtggtgaagccagtgtgaacccaggcaatctgacctctaagtttggatatctaactgctctgctgtgttgctttcccattatatgcttaagctaactaattagaaaagggcatatctattttcctggatataatatatttggtgagttcttactaatggtgtgacttttggtatctttagagttcccaaattgaaacgtctttttaaggagaggcacttgaactgggaggaccttatctaacatttagaataaaaatactgttgcctagagaatatagaccaagtaaataacatttctcacataatgaatcctagacaagcacatcacatttacacaaacccaatctctggtgttgaaggtctaaagaactagaataggcgagctgtgctcttttgtgcaaagctctttaggggaactgattgctt

SEQ ID NO: 307188 - DNA, 695 bp, Homo sapiens
ctaagtggtaaaaaacacacacacagtgatgactcatcagttgaaatcaaatccttcatcccaaaaaagtgtttttataagaagtgggtgtttttttctttccccaaaggcagactgcataatatttggtgcttctcttttctgaataatttattccgtttcagtggaaattgacagtttcagactggagccaataacattttattttcagagctatgcttggtacccccattatccagggatctgcttttgcctacaaccctaaggggagttcagccatcaaaccgtttcacaccagcacaattcccctcttcctcccttccctttgaccagctactaacctgttcttctgaagaccctggagcagaataaatgcctagagagagcatttggagaccgcatccaggtatacaaaagcatggcaagtttattgtttttcaggagcccaatcacagaatcgatccatatctcctgacccaggtactccactcagaagtctgttcttttcacagctctcctctacaaaacattttctttctgttgtttctttcctaagactctacaactctgaaagaaagcaacgtgattcacttctgatccgtgaaagtaaacatcctattccattccatttgtcttcttggaagcttccacaaatgtctccttgctagaaaacaaaaatacaaaacttgtactca

SEQ ID NO: 307189 - DNA, 400 bp, Homo sapiens
tttctctaatgtgagctgcttcctgttgctaaaacactgccccttcaaatgagattgtttgctaagtgaggcatctccttcctctttcttccttggatgaattagcaagcaagaagagtcagtctgaggctcctcactgtgacggactgaggagctttatttactccctgcggatagtggcctgccaccagagaggccacaggccggagtgatggagctgactcatagggtaaggagaaagtggcctggatcgttgacagagcacgtgaggacacaagaagaaggcatctgtttacacaccaggaggagagacctcacaagaacccaatcatgatggcactttgatcttagaccgccagcctccagaacagtgagaaaataaatttctgttgtttatgct

SEQ ID NO: 307190 - DNA, 540 bp, Homo sapiens
ctaagtggtaaaaaacacacacacagtgatgactcatcagttgaaatcaaatccttcatcccaaaaaagtgtttttataagaagtgggtgtttttttctttccccaaaggcagactgcataatatttggtgcttctcttttctgaataatttattccgtttcagtggaaattgacagtttcagactggagccaataacattttattttcagagctatgcttggtacccccattatccagggatctgcttttgcctacaaccctaaggggagttcagccatcaaaccgtttcacaccagcacaattcccctcttcctcccttccctttgaccagctactaacctgttcttctgaagaccctggagcagaataaatgcctagagagagcatttggagaccgcatcacgtgaggacacaagaagaaggcatctgtttacacaccaggaggagagacctcacaagaacccaatcatgatggcactttgatcttagaccgccagcctccagaacagtgagaaaataaatttctgttgtttatgct

SEQ ID NO: 307191 - DNA, 219 bp, Homo sapiens
ggaaccaatgccacagggtaactttgtgaaggtgtggaccattttctgaaaccaacttaaggcaccagctcatattggaagcacgtgaggacacaagaagaaggcatctgtttacacaccaggaggagagacctcacaagaacccaatcatgatggcactttgatcttagaccgccagcctccagaacagtgagaaaataaatttctgttgtttatgct

SEQ ID NO: 307192 - DNA, 303 bp, Homo sapiens
aggtggcgtggggaggtggggaacggcccgggactcgcacgtggaggtggagcgcggacgcctccctcagccagggcaagactaaggagctgggcgaacagtcagcttcaacaagcagcaggtttgatcaaccattcttctcagagcaagaaacctaccatactgcacgtgaggacacaagaagaaggcatctgtttacacaccaggaggagagacctcacaagaacccaatcatgatggcactttgatcttagaccgccagcctccagaacagtgagaaaataaatttctgttgtttatgct

SEQ ID NO: 307193 - DNA, 4630 bp, Homo sapiens
actggaagcgtccaaagagggacggctgtcagccctgcttgactgagaacccaccagctcatcccagacacctcatagcaacctatttatacaaagggggaaagaaacacctgagcagaatggaatcattatttttttcccaaggagaaaaccggggtaaagggagggaagcaattcaatttgaagtccctgtgaatgggctttcagaaggcaattaaagaaatccactcagagaggacttggggtgaaacttgggtcctgtggttttctgattgtaagtggaagcaggtcttgcacacgctgttggcaaatgtcaggaccaggttaagtgactggcagaaaaacttccaggtggaacaagcaacccaggttctgctgcaagcttgaaggagcctggagcgggagaaagctaacttgaacatgacctgttgcatttggcaagttctagcaacatgctcctaaggaagcgatacaggcacagaccatgcagactccagttcctcctgctgctcctgatgctgggatgcgtcctgatgatggtggcgatgttgcaccctccccaccacaccctgcaccagactgtcacagcccaagccagcaagcacagccctgaagccaggtaccgcctggactttggggaatcccaggattgggtactggaagctgaggatgagggtgaagagtacagccctctggagggcctgccaccctttatctcactgcgggaggatcagctgctggtggccgtggccttaccccaggccagaaggaaccagagccagggcaggagaggtgggagctaccgcctcatcaagcagccaaggaggcaggataaggaagccccaaagagggactggggggctgatgaggacggggaggtgtctgaagaagaggagttgaccccgttcagcctggacccacgtggcctccaggaggcactcagtgcccgcatccccctccagagggctctgcccgaggtgcggcacccactgtgtctgcagcagcaccctcaggacagcctgcccacagccagcgtcatcctctgtttccatgatgaggcctggtccactctcctgcggactgtacacagcatcctcgacacagtgcccagggccttcctgaaggagatcatcctcgtggacgacctcagccagcaaggacaactcaagtctgctctcagcgaatatgtggccaggctggagggggtgaagttactcaggagcaacaagaggctgggtgccatcagggcccggatgctgggggccaccagagccaccggggatgtgctcgtcttcatggatgcccactgcgagtgccacccaggctggctggagcccctcctcagcagaatagctggtgacaggagccgagtggtatctccggtgatagatgtgattgactggaagactttccagtattacccctcaaaggacctgcagcgtggggtgttggactggaagctggatttccactgggaacctttgccagagcatgtgaggaaggccctccagtcccccataagccccatcaggagccctgtggtgcccggagaggtggtggccatggacagacattacttccaaaacactggagcgtatgactctcttatgtcgctgcgaggtggtgaaaacctcgaactgtctttcaaggcctggctctgtggtggctctgttgaaatccttccctgctctcgggtaggacacatctaccaaaatcaggattcccattcccccctcgaccaggaggccaccctgaggaacagggttcgcattgctgagacctggctggggtcattcaaagaaaccttctacaagcatagcccagaggccttctccttgagcaaggctgagaagccagactgcatggaacgcttgcagctgcaaaggagactgggttgtcggacattccactggtttctggctaatgtctaccctgagctgtacccatctgaacccaggcccagtttctctggaaagctccacaacactggacttgggctctgtgcagactgccaggcagaaggggacatcctgggctgtcccatggtgttggctccttgcagtgacagccggcagcaacagtacctgcagcacaccagcaggaaggagattcactttggcagcccacagcacctgtgctttgctgtcaggcaggagcaggtgattcttcagaactgcacggaggaaggcctggccatccaccagcagcactgggacttccaggagaatgggatgattgtccacattctttctgggaaatgcatggaagctgtggtgcaagaaaacaataaagatttgtacctgcgtccgtgtgatggaaaagcccgccagcagtggcgttttgaccagatcaatgctgtggatgaacgatgaatgtcaatgtcagaaggaaaagagaattttggccatcaaaatccagctccaagtgaacttaaagagcttatatatttcatgaagctgatccttttgtgtgtgtgctcctggtgttaggagagaaaaaagctctatgaaagaatataggaagtttctccttttcacaccttatttcattgactgctggctgctttaaaaaaaaaaaaaaaggatccattgtaccgttgtcttcatcactgggaaatgattattacatagtacagaagattctttgtttttctccactgagcacttaacaattgctttctctctggcctggacattctctggcagcacctccaggatacataaattcaatggatcaatttatttgtcttcaaatggccttaacttggattgtctgtttggccaaccatgaaaattaaagagtgaagcagatgtaatggcctgacattccaaaaactctgaattgggtttattagcacaaatgttgtgttcatttgttgagccatatctcagaagaaggaaagggagctacagaaaggaggtttaggattgcagagaagatgcaagagcactttggcccaattctccagctcaacccagcagctgaaaagcttcaagagatctaggaaaagacattttcatgttaatgagaatttccaccattgtagagaatttccttcctactgagaatctacctctattccccctgccctagctcttctctaacttggttaaccataaccataaccagattcccttgcaatcgatttctctttagtcgttggtgttagaagtaccagcacaatttgagcattcccattaacaaaggtgttcacagttgagaaactctcctgccgggcgcggtggctcatgcctgtaattccagcactttgggaggcagagttgggaggatcacctgatgtcaggggtttgagaccagcctggtcaacattgcaaaaccttgtctctactaaaaatacaaaaattagctgggcatggtggcgcatacctgtaatcccagctacttgggaggctgaggcaagagaatcgcttgaacccaggaggcagaggttgcagtgagctgagatcatgccattgcactccaacctgggtgacagagtgagactccatctcaaaaaaaaaaaaaaaagagagaaactctcctgatgccctgttacagggtttgcactgactggagcagaaacagcaacctttctaaaaaagcaaacctttttcctgggaggaaaatgccagagcctgagccaaaattcttatgacaggtaacatttgggtgttaatgtccatgagagctgacagggccatctctgagcccatataactgtctggaacccccaaatgtgtccacaggttgaatgtccatgagtgtgggaagaacacggctcatctggagcacagctgaggctagtaagagctaaatgactttccttgctatgacttggcttacctgaattagctgtaagagttgccgaatgggatgggttctgctatttaataaacagcattcatattcatttttccccagatggagttacctacctttccacatggtcagcttagaaatcttcccctaaagatgctaatctcctttgggctgtctcagaacacagtatccttcaaataagaaaaactgagtgggaagtgcagtgtttccaaacaatacctatcataactacgtattcattgtctacctgctaagtcaagggttcactgcatttctccttcctcagaatacactctggacctgtgctgtctaatatggtagccactaacaaaatgtggccattttgatggaaatccattaaaatcaaagaaaatttaaaactcaattcctcaattgggctggccacatttcaaatgctcactacccacctgtggctagggtctacttctactgtattggcgagcatggatatagaacatttcatcacagttctgttggaccaatctagatagattcattatcccatctagagaagagactttagtcactgtcttcttgcttcagacccatctatatttaaaacaaatttccctaaatcctgagactgagacggagctacaaattctcagatggcgaccgtgtaaatggtattagcggctgaagaaaaaaaatttttcaagacctctgttttttaactgaactttatcattggcattgtgggtctttgaagttgctgggataaattaatataattaaataaaagactgaatttaattgcaaaaaaatatta

SEQ ID NO: 307194 - DNA, 2917 bp, Homo sapiens
agcggagtggcgcattcccggaggaaggtcatgtaccagttaaacgccaccgttttgcctcttagtgcacatgcttgagcccacttgcccaactcctgagatcatatcgggaagctgatcaccaatttcaggctgagaagccagactgcatggaacgcttgcagctgcaaaggagactgggttgtcggacattccactggtttctggctaatgtctaccctgagctgtacccatctgaacccaggcccagtttctctggaaagctccacaacactggacttgggctctgtgcagactgccaggcagaaggggacatcctgggctgtcccatggtgttggctccttgcagtgacagccggcagcaacagtacctgcagcacaccagcaggaaggagattcactttggcagcccacagcacctgtgctttgctgtcaggcaggagcaggtgattcttcagaactgcacggaggaaggcctggccatccaccagcagcactgggacttccaggagaatgggatgattgtccacattctttctgggaaatgcatggaagctgtggtgcaagaaaacaataaagatttgtacctgcgtccgtgtgatggaaaagcccgccagcagtggcgttttgaccagatcaatgctgtggatgaacgatgaatgtcaatgtcagaaggaaaagagaattttggccatcaaaatccagctccaagtgaacttaaagagcttatatatttcatgaagctgatccttttgtgtgtgtgctcctggtgttaggagagaaaaaagctctatgaaagaatataggaagtttctccttttcacaccttatttcattgactgctggctgctttaaaaaaaaaaaaaaaggatccattgtaccgttgtcttcatcactgggaaatgattattacatagtacagaagattctttgtttttctccactgagcacttaacaattgctttctctctggcctggacattctctggcagcacctccaggatacataaattcaatggatcaatttatttgtcttcaaatggccttaacttggattgtctgtttggccaaccatgaaaattaaagagtgaagcagatgtaatggcctgacattccaaaaactctgaattgggtttattagcacaaatgttgtgttcatttgttgagccatatctcagaagaaggaaagggagctacagaaaggaggtttaggattgcagagaagatgcaagagcactttggcccaattctccagctcaacccagcagctgaaaagcttcaagagatctaggaaaagacattttcatgttaatgagaatttccaccattgtagagaatttccttcctactgagaatctacctctattccccctgccctagctcttctctaacttggttaaccataaccataaccagattcccttgcaatcgatttctctttagtcgttggtgttagaagtaccagcacaatttgagcattcccattaacaaaggtgttcacagttgagaaactctcctgccgggcgcggtggctcatgcctgtaattccagcactttgggaggcagagttgggaggatcacctgatgtcaggggtttgagaccagcctggtcaacattgcaaaaccttgtctctactaaaaatacaaaaattagctgggcatggtggcgcatacctgtaatcccagctacttgggaggctgaggcaagagaatcgcttgaacccaggaggcagaggttgcagtgagctgagatcatgccattgcactccaacctgggtgacagagtgagactccatctcaaaaaaaaaaaaaaaagagagaaactctcctgatgccctgttacagggtttgcactgactggagcagaaacagcaacctttctaaaaaagcaaacctttttcctgggaggaaaatgccagagcctgagccaaaattcttatgacaggtaacatttgggtgttaatgtccatgagagctgacagggccatctctgagcccatataactgtctggaacccccaaatgtgtccacaggttgaatgtccatgagtgtgggaagaacacggctcatctggagcacagctgaggctagtaagagctaaatgactttccttgctatgacttggcttacctgaattagctgtaagagttgccgaatgggatgggttctgctatttaataaacagcattcatattcatttttccccagatggagttacctacctttccacatggtcagcttagaaatcttcccctaaagatgctaatctcctttgggctgtctcagaacacagtatccttcaaataagaaaaactgagtgggaagtgcagtgtttccaaacaatacctatcataactacgtattcattgtctacctgctaagtcaagggttcactgcatttctccttcctcagaatacactctggacctgtgctgtctaatatggtagccactaacaaaatgtggccattttgatggaaatccattaaaatcaaagaaaatttaaaactcaattcctcaattgggctggccacatttcaaatgctcactacccacctgtggctagggtctacttctactgtattggcgagcatggatatagaacatttcatcacagttctgttggaccaatctagatagattcattatcccatctagagaagagactttagtcactgtcttcttgcttcagacccatctatatttaaaacaaatttccctaaatcctgagactgagacggagctacaaattctcagatggcgaccgtgtaaatggtattagcggctgaagaaaaaaaatttttcaagacctctgttttttaactgaactttatcattggcattgtgggtctttgaagttgctgggataaattaatataattaaataaaagactgaatttaattgcaaaaaaatatta

SEQ ID NO: 307195 - DNA, 4006 bp, Homo sapiens
aggtggcgtggggaggtggggaacggcccgggactcgcacgtggaggtggagcgcggacgcctccctcagccagggcaagactaaggagctgggcgaacagtcagcttcaacaagcagcaggtttgatcaaccattcttctcagagcaagaaacctaccatactgcatttcttcctgctatcatgtgaagaagaacgtgtttgcttccccttctaccatgattgtaagtttcctgaggcctccccagcctagcagaactcacgtgaggacacaagaagaaggcatctgtttacacaccaggaggagagacctcacaagaacccaatcatgatggcactttgatcttagaccgccagcctccagaacagtgtctgcagcagcaccctcaggacagcctgcccacagccagcgtcatcctctgtttccatgatgaggcctggtccactctcctgcggactgtacacagcatcctcgacacagtgcccagggccttcctgaaggagatcatcctcgtggacgacctcagccagcaaggacaactcaagtctgctctcagcgaatatgtggccaggctggagggggtgaagttactcaggagcaacaagaggctgggtgccatcagggcccggatgctgggggccaccagagccaccggggatgtgctcgtcttcatggatgcccactgcgagtgccacccaggctggctggagcccctcctcagcagaatagctggtgacaggagccgagtggtatctccggtgatagatgtgattgactggaagactttccagtattacccctcaaaggacctgcagcgtggggtgttggactggaagctggatttccactgggaacctttgccagagcatgtgaggaaggccctccagtcccccataagccccatcaggagccctgtggtgcccggagaggtggtggccatggacagacattacttccaaaacactggagcgtatgactctcttatgtcgctgcgaggtggtgaaaacctcgaactgtctttcaaggcctggctctgtggtggctctgttgaaatccttccctgctctcgggtaggacacatctaccaaaatcaggattcccattcccccctcgaccaggaggccaccctgaggaacagggttcgcattgctgagacctggctggggtcattcaaagaaaccttctacaagcatagcccagaggccttctccttgagcaaggctgagaagccagactgcatggaacgcttgcagctgcaaaggagactgggttgtcggacattccactggtttctggctaatgtctaccctgagctgtacccatctgaacccaggcccagtttctctggaaagctccacaacactggacttgggctctgtgcagactgccaggcagaaggggacatcctgggctgtcccatggtgttggctccttgcagtgacagccggcagcaacagtacctgcagcacaccagcaggaaggagattcactttggcagcccacagcacctgtgctttgctgtcaggcaggagcaggtgattcttcagaactgcacggaggaaggcctggccatccaccagcagcactgggacttccaggagaatgggatgattgtccacattctttctgggaaatgcatggaagctgtggtgcaagaaaacaataaagatttgtacctgcgtccgtgtgatggaaaagcccgccagcagtggcgttttgaccagatcaatgctgtggatgaacgatgaatgtcaatgtcagaaggaaaagagaattttggccatcaaaatccagctccaagtgaacttaaagagcttatatatttcatgaagctgatccttttgtgtgtgtgctcctggtgttaggagagaaaaaagctctatgaaagaatataggaagtttctccttttcacaccttatttcattgactgctggctgctttaaaaaaaaaaaaaaaggatccattgtaccgttgtcttcatcactgggaaatgattattacatagtacagaagattctttgtttttctccactgagcacttaacaattgctttctctctggcctggacattctctggcagcacctccaggatacataaattcaatggatcaatttatttgtcttcaaatggccttaacttggattgtctgtttggccaaccatgaaaattaaagagtgaagcagatgtaatggcctgacattccaaaaactctgaattgggtttattagcacaaatgttgtgttcatttgttgagccatatctcagaagaaggaaagggagctacagaaaggaggtttaggattgcagagaagatgcaagagcactttggcccaattctccagctcaacccagcagctgaaaagcttcaagagatctaggaaaagacattttcatgttaatgagaatttccaccattgtagagaatttccttcctactgagaatctacctctattccccctgccctagctcttctctaacttggttaaccataaccataaccagattcccttgcaatcgatttctctttagtcgttggtgttagaagtaccagcacaatttgagcattcccattaacaaaggtgttcacagttgagaaactctcctgccgggcgcggtggctcatgcctgtaattccagcactttgggaggcagagttgggaggatcacctgatgtcaggggtttgagaccagcctggtcaacattgcaaaaccttgtctctactaaaaatacaaaaattagctgggcatggtggcgcatacctgtaatcccagctacttgggaggctgaggcaagagaatcgcttgaacccaggaggcagaggttgcagtgagctgagatcatgccattgcactccaacctgggtgacagagtgagactccatctcaaaaaaaaaaaaaaaagagagaaactctcctgatgccctgttacagggtttgcactgactggagcagaaacagcaacctttctaaaaaagcaaacctttttcctgggaggaaaatgccagagcctgagccaaaattcttatgacaggtaacatttgggtgttaatgtccatgagagctgacagggccatctctgagcccatataactgtctggaacccccaaatgtgtccacaggttgaatgtccatgagtgtgggaagaacacggctcatctggagcacagctgaggctagtaagagctaaatgactttccttgctatgacttggcttacctgaattagctgtaagagttgccgaatgggatgggttctgctatttaataaacagcattcatattcatttttccccagatggagttacctacctttccacatggtcagcttagaaatcttcccctaaagatgctaatctcctttgggctgtctcagaacacagtatccttcaaataagaaaaactgagtgggaagtgcagtgtttccaaacaatacctatcataactacgtattcattgtctacctgctaagtcaagggttcactgcatttctccttcctcagaatacactctggacctgtgctgtctaatatggtagccactaacaaaatgtggccattttgatggaaatccattaaaatcaaagaaaatttaaaactcaattcctcaattgggctggccacatttcaaatgctcactacccacctgtggctagggtctacttctactgtattggcgagcatggatatagaacatttcatcacagttctgttggaccaatctagatagattcattatcccatctagagaagagactttagtcactgtcttcttgcttcagacccatctatatttaaaacaaatttccctaaatcctgagactgagacggagctacaaattctcagatggcgaccgtgtaaatggtattagcggctgaagaaaaaaaatttttcaagacctctgttttttaactgaactttatcattggcattgtgggtctttgaagttgctgggataaattaatataattaaataaaagactgaatttaattgcaaaaaaatatta

SEQ ID NO: 307196 - DNA, 3447 bp, Homo sapiens
actggaagcgtccaaagagggacggctgtcagccctgcttgactgagaacccaccagctcatcccagacacctcatagcaacctatttatacaaagggggaaagaaacacctgagcagaatggaatcattatttttttcccaaggagaaaaccggggtaaagggagggaagcaattcaatttgaagtccctgtgaatgggctttcagaaggcaattaaagaaatccactcagagaggacttggggtgaaacttgggtcctgtggttttctgattgtaagtggaagcaggtcttgcacacgctgttggcaaatgtcaggaccaggttaagtgactggcagaaaaacttccaggtggaacaagcaacccaggttctgctgcaagcttgaaggagcctggagcgggagaaagctaacttgaacatgacctgttgcatttggcaagttctagcaacatgctcctaaggaagcgatacaggcacagaccatgcagactccagttcctcctgctgctcctgatgctgggatgcgtcctgatgatggtggcgatgttgcaccctccccaccacaccctgcaccagactgtcacagcccaagccagcaagcacagccctgaagccaggtaccgcctggactttggggaatcccaggattgggtactggaagctgaggatgagggtgaagagtacagccctctggagggcctgccaccctttatctcactgcgggaggatcagctgctggtggccgtggccttaccccaggccagaaggaaccagagccagggcaggagaggtgggagctaccgcctcatcaagcagccaaggaggcaggataaggaagccccaaagagggactggggggctgatgaggacggggaggtgtctgaagaagaggagttgaccccgttcagcctggacccacgtggcctccaggaggcactcagtgcccgcatccccctccagagggctctgcccgaggtgcggcacccactgtgtctgcagcagcaccctcaggacagcctgcccacagccagcgtcatcctctgtttccatgatgaggcctggtccactctcctgcggactgtacacagcatcctcgacacagtgcccagggccttcctgaaggagatcatcctcgtggacgacctcagccagcaaggacaactcaagtctgctctcagcgaatatgtggccaggctggagggggtgaagttactcaggagcaacaagaggctgggtgccatcagggcccggatgctgggggccaccagagccaccggggatgtgctcgtcttcatggatgcccactgcgagtgccacccaggctggctggagcccctcctcagcagaatagctggtgacaggagccgagtggtatctccggtgatagatgtgattgactggaagactttccagtattacccctcaaaggacctgcagcgtggggtgttggactggaagctggatttccactgggaacctttgccagagcatgtgaggaaggccctccagtcccccataagccccatcaggagccctgtggtgcccggagaggtggtggccatggacagacattacttccaaaacactggagcgtatgactctcttatgtcgctgcgaggtggtgaaaacctcgaactgtctttcaaggcctggctctgtggtggctctgttgaaatccttccctgctctcgggtaggacacatctaccaaaatcaggattcccattcccccctcgaccaggaggccaccctgaggaacagggttcgcattgctgagacctggctggggtcattcaaagaaaccttctacaagcatagcccagaggccttctccttgagcaaggctgagaagccagactgcatggaacgcttgcagctgcaaaggagactgggttgtcggacattccactggtttctggctaatgtctaccctgagctgtacccatctgaacccaggcccagtttctctggaaagctccacaacactggacttgggctctgtgcagactgccaggcagaaggggacatcctgggctgtcccatggtgttggctccttgcagtgacagccggcagcaacagtacctgcagcacaccagcaggaaggagattcactttggcagcccacagcacctgtgctttgctgtcaggcaggagcaggtgattcttcagaactgcacggaggaaggcctggccatccaccagcagcactgggacttccaggagaatgggatgattgtccacattctttctgggaaatgcatggaagctgtggtgcaagaaaacaataaagatttgtacctgcgtccgtgtgatggaaaagcccgccagcagtggcgttttgaccagatcaatgctgtggatgaacgatgaatgtcaatgtcagaaggaaaagagaattttggccatcaaaatccagctccaagtgaacttaaagagcttatatatttcatgaagctgatccttttgtgtgtgtgctcctggtgttaggagagaaaaaagctctatgaaagaatataggaagtttctccttttcacaccttatttcattgactgctggctgctttaaaaaaaaaaaaaaaggatccattgtaccgttgtcttcatcactgggaaatgattattacatagtacagaagattctttgtttttctccactgagcacttaacaattgctttctctctggcctggacattctctggcagcacctccaggatacataaattcaatggatcaatttatttgtcttcaaatggccttaacttggattgtctgtttggccaaccatgaaaattaaagagtgaagcagatgtaatggcctgacattccaaaaactctgaattgggtttattagcacaaatgttgtgttcatttgttgagccatatctcagaagaaggaaagggagctacagaaaggaggtttaggattgcagagaagatgcaagagcactttggcccaattctccagctcaacccagcagctgaaaagcttcaagagatctaggaaaagacattttcatgttaatgagaatttccaccattgtagagaatttccttcctactgagaatctacctctattccccctgccctagctcttctctaacttggttaaccataaccataaccagattcccttgcaatcgatttctctttagtcgttggtgttagaagtaccagcacaatttgagcattcccattaacaaaggtgttcacagttgagaaactctcctgccgggcgcggtggctcatgcctgtaattccagcactttgggaggcagagttgggaggatcacctgatgtcaggggtttgagaccagcctggtcaacattgcaaaaccttgtctggcctcaaagaagtcttatgagtcaagttaaggtcctttataaatgatcataaagtatttttctaagcaagtcctatgaataagatatactttagaaacagc

SEQ ID NO: 307197 - DNA, 2560 bp, Homo sapiens
actggaagcgtccaaagagggacggctgtcagccctgcttgactgagaacccaccagctcatcccagacacctcatagcaacctatttatacaaagggggaaagaaacacctgagcagaatggaatcattatttttttcccaaggagaaaaccggggtaaagggagggaagcaattcaatttgaagtccctgtgaatgggctttcagaaggcaattaaagaaatccactcagagaggacttggggtgaaacttgggtcctgtggttttctgattgtaagtggaagcaggtcttgcacacgctgttggcaaatgtcaggaccaggttaagtgactggcagaaaaacttccaggtggaacaagcaacccaggttctgctgcaagcttgaaggagcctggagcgggagaaagctaacttgaacatgacctgttgcatttggcaagttctagcaacatgctcctaaggaagcgatacaggcacagaccatgcagactccagttcctcctgctgctcctgatgctgggatgcgtcctgatgatggtggcgatgttgcaccctccccaccacaccctgcaccagactgtcacagcccaagccagcaagcacagccctgaagccaggtaccgcctggactttggggaatcccaggattgggtactggaagctgaggatgagggtgaagagtacagccctctggagggcctgccaccctttatctcactgcgggaggatcagctgctggtggccgtggccttaccccaggccagaaggaaccagagccagggcaggagaggtgggagctaccgcctcatcaagcagccaaggaggcaggataaggaagccccaaagagggactggggggctgatgaggacggggaggtgtctgaagaagaggagttgaccccgttcagcctggacccacgtggcctccaggaggcactcagtgcccgcatccccctccagagggctctgcccgaggtgcggcacccactgtgtctgcagcagcaccctcaggacagcctgcccacagccagcgtcatcctctgtttccatgatgaggcctggtccactctcctgcggactgtacacagcatcctcgacacagtgcccagggccttcctgaaggagatcatcctcgtggacgacctcagccagcaaggacaactcaagtctgctctcagcgaatatgtggccaggctggagggggtgaagttactcaggagcaacaagaggctgggtgccatcagggcccggatgctgggggccaccagagccaccggggatgtgctcgtcttcatggatgcccactgcgagtgccacccaggctggctggagcccctcctcagcagaatagctggtgacaggagccgagtggtatctccggtgatagatgtgattgactggaagactttccagtattacccctcaaaggacctgcagcgtggggtgttggactggaagctggatttccactgggaacctttgccagagcatgtgaggaaggccctccagtcccccataagccccatcaggagccctgtggtgcccggagaggtggtggccatggacagacattacttccaaaacactggagcgtatgactctcttatgtcgctgcgaggtggtgaaaacctcgaactgtctttcaaggcctggctctgtggtggctctgttgaaatccttccctgctctcgggtaggacacatctaccaaaatcaggattcccattcccccctcgaccaggaggccaccctgaggaacagggttcgcattgctgagacctggctggggtcattcaaagaaaccttctacaagcatagcccagaggccttctccttgagcaaggctgagaagccagactgcatggaacgcttgcagctgcaaaggagactgggttgtcggacattccactggtttctggctaatgtctaccctgagctgtacccatctgaacccaggcccagtttctctggaaagctccacaacactggacttgggctctgtgcagactgccaggcagaaggggacatcctgggctgtcccatggtgttggctccttgcagtgacagccggcagcaacagtacctgcagcacaccagcaggaaggagattcactttggcagcccacagcacctgtgctttgctgtcaggcaggagcaggtgattcttcagaactgcacggaggaaggcctggccatccaccagcagcactgggacttccaggagttctgcaggctgcacaggaagcatggctgaggaggcctcaggaaacttacaatcatggcagaaggcgaagaggaagcaagccccgtccttacatggcggagcaagggagagagagagtgaaggaggaggtgctacacacttccaaacaaccaatcttgtgagaactctatcaagaaaacagcaagggggaagtctgccccatgattcaatcacctcccaccaggcccctcttccaacactgggaattacaattcaacatgagatttcagtggggacacagaaccaaaccatatcaatctcaaacattaataaatgaatgatgaataaataggcat

SEQ ID NO: 307198 - DNA, 278 bp, Homo sapiens
atatttatatatagctatagatagctttcaaatatggctttgaaatatttaaatgtaagtcagaattatatagacaaatggacaaaatctgcaatcatagattttaacatttccatcagaaattgatatactagccaggcttacacctgtaatcccagcactttgggaggctgaggttggaggatcacatgagcccaagagttttgagactagcctgtgtaacatagggagaccacatctctaggaaaaaaaaaatttttttttttttttgagactga

SEQ ID NO: 307199 - DNA, 772 bp, Homo sapiens
tagaagttttttttaataattactatgcttatttaataatttaaagaattgcttaatttgtagaggtggaagaggctttagaaattctatactccactgattttaagtctgtattccaaagtcctagagtactgaggaggcacctcagggtcttctgctggagtgaagtgtagaaaaagtgagtagttccacaccatttgaaccagaggatttgtgtttttatctgttacatagttctgttttactcccaggccctgtgtgaggatgggaatccaggatatgtccatctcagacaggcaggtctcttacttaccctggacagtactgcttcctcttctttagtcaccatcaccattgactccagaatgactaaacaacagaaatgtattctgaaacctgctctagatccctaatgactttattcacagaagtttatctgagaaggttttctgattaaatgaaatagacctcaaagtatcaactttacatctcttgggaggcagcacggtgtctgcaaagataaactttaaagatatataaccctttcacttactagagctatgtatgttggaaggaaaggtgtatcttaacctctttgtacttcagtctactcatttataaaattatcacaacctattttcacaggtactaaaatacctggtaaaatgcctagtatatagtaggtattcattgtttgtatacttccaacctgatattaaagatattaaactttaatatctttgaggtgtctgcctcatttttctatatttct

SEQ ID NO: 307200 - DNA, 1234 bp, Homo sapiens
atgaggagggacgagcgagacgccaaagccatgcggtccctgcagccgccggatggggccggctcgccccccgagagtctgaggaacggctacgtgaagagctgcgtgagccccttgcggcaggaccctccgcgcggcttcttcttccacctctgccgcttctgcaacgtggagctgcggccgccgccggcctctccccagcagccgcggcgctgctcccccttctgccgggcgcgcctctcgctgggcgccctggctgcctttgtcctcgccctgctgctgggcgcggaacccgagagctgggctgccggggccgcctggctgcggacgctgctgagcgtgtgttcgcacagcttgagccccctcttcagcatcgcctgtgccttcttcttcctcacctgcttcctcacccggaccaagcggggacccggcccgggccggagctgcggctcctggtggctgctggcgctgcccgcctgctgttacctgggggacttcttggtgtggcagtggtggtcttggccttggggggatggcgacgcagggtccgcggccccgcacacgcccccggaggcggcagcgggcaggttgctgctggtgctgagctgcgtagggctgctgctgacgctcgcgcacccgctgcggctccggcactgcgttctggtgctgctcctggccagcttcgtctggtgggtctccttcaccagcctcgggtcgctgccctccgccctcaggccgctgctctccggcctggtggggggcgctggctgcctgctggccctggggttggatcacttctttcaaatcagggaagcgcctcttcatcctcgactgtccagtgccgccgaagaaaaagtgcctgtgatccgaccccggaggaggtccagctgcgtgtcgttaggagaaactgcagccagttactatggcagttgcaaaatattcaggagaccgtcgttgccttgtatttccagagaacagatgattctttgggattgggacttaaaacaatggtgtattctggatgtctactcaaggccaaaccccagtattgcctttcgtttccctattcaaggccaaggctagattctcttcattgtctccatttctctttctccagagctcctatagggcaagacactgtttctcatatatttctggatccttggagcttagctcggagcttggcatacatgcccagcatgaacttttctgaataaaataatttcaaatgctg

SEQ ID NO: 307201 - DNA, 5735 bp, Homo sapiens
atgaggagggacgagcgagacgccaaagccatgcggtccctgcagccgccggatggggccggctcgccccccgagagtctgaggaacggctacgtgaagagctgcgtgagccccttgcggcaggaccctccgcgcggcttcttcttccacctctgccgcttctgcaacgtggagctgcggccgccgccggcctctccccagcagccgcggcgctgctcccccttctgccgggcgcgcctctcgctgggcgccctggctgcctttgtcctcgccctgctgctgggcgcggaacccgagagctgggctgccggggccgcctggctgcggacgctgctgagcgtgtgttcgcacagcttgagccccctcttcagcatcgcctgtgccttcttcttcctcacctgcttcctcacccggaccaagcggggacccggcccgggccggagctgcggctcctggtggctgctggcgctgcccgcctgctgttacctgggggacttcttggtgtggcagtggtggtcttggccttggggggatggcgacgcagggtccgcggccccgcacacgcccccggaggcggcagcgggcaggttgctgctggtgctgagctgcgtagggctgctgctgacgctcgcgcacccgctgcggctccggcactgcgttctggtgctgctcctggccagcttcgtctggtgggtctccttcaccagcctcgggtcgctgccctccgccctcaggccgctgctctccggcctggtggggggcgctggctgcctgctggccctggggttggatcacttctttcaaatcagggaagcgcctcttcatcctcgactgtccagtgccgccgaagaaaaagtgcctgtgatccgaccccggaggaggtccagctgcgtgtcgttaggagaaactgcagccagttactatggcagttgcaaaatattcaggagaccgtcgttgccttgtatttccagagaacagatgattctttgggattgggacttaaaacaatggtataagcctcattatcaaaattctggaggtggaaatggagttgatctttcagtgctaaatgaggctcgcaatatggtgtcagatcttctgactgatccaagccttccaccacaagtcatttcctctctacggagtattagtagcttaatgggtgctttctcaggttcctgtaggccaaagattaatcctctcacaccatttcctggattttacccctgttctgaaatagaggacccagctgagaaaggggatagaaaacttaacaagggactaaataggaatagtttgccaactccacagctgaggagaagctcaggaacttcaggattgctacctgttgaacagtcttcaaggtgggatcgtaataatggcaaaaggcctcaccaagaatttggcatttcaagtcaaggatgctatctaaatgggccttttaattcaaatctactgactatcccgaagcaaaggtcatcttctgtatcactgactcaccatgtaggtctcagaagagctggtgttttgtccagtctgagtcctgtgaattcttccaaccatggaccagtgtctactggctctctaactaatcgatcacccatagaatttcctgatactgctgattttcttaataagccaagcgttatcttgcagagatctctgggcaatgcacctaatactccagatttttatcagcaacttagaaattctgatagcaatctgtgtaacagctgtggacatcaaatgctgaaatatgtttcaacatctgaatcagatggtacagattgctgcagtggaaaatcaggtgaagaagaaaacattttctcgaaagaatcattcaaacttatggaaactcaacaagaagaggaaacagagaagaaagacagcagaaaattatttcaggaaggtgataagtggctaacagaagaggcacagagtgaacagcaaacaaatattgaacaggaagtatcactggacctgattttagtagaagagtatgactcattaatagaaaagatgagcaactggaattttccaatttttgaacttgtagaaaagatgggagagaaatcaggaaggattctcagtcaggttatgtataccttatttcaagacactggtttattggaaatatttaaaattcccactcaacaatttatgaactattttcgtgcattagaaaatggctatcgagacattccttatcacaatcgtatacatgccacagatgtgctacatgcagtttggtatctgacaacacggccagttcctggcttacagcagatccacaatggttgtggaacaggaaatgaaacagattctgatggtagaattaaccatgggcgaattgcttatatttcttcgaagagctgctctaatcctgatgagagttatggctgcctgtcttcaaacattcctgcattagaattgatggctctatacgtggcagctgccatgcatgattatgatcacccagggaggacaaatgcatttctagtggctacaaatgcccctcaggcagttttatacaatgacagatctgttctggaaaatcatcatgctgcgtcagcttggaatctatatctttctcgcccagaatacaacttccttcttcatcttgatcatgtggaattcaagcgctttcgttttttagtcattgaagcaatccttgctacggatcttaaaaagcattttgattttctcgcagaattcaatgccaaggcaaatgatgtaaatagtaatggcatagaatggagtaatgaaaatgatcgcctcttggtatgccaggtgtgcatcaaactggcagatataaatggcccagcaaaagttcgagacttgcatttgaaatggacagaaggcattgtcaatgaattttatgagcagggagatgaagaagcaaatcttggtctgcccatcagtccattcatggatcgttcttctcctcaactagcaaaactccaagaatcttttatcacccacatagtgggtcccctgtgtaactcctatgatgctgctggtttgctaccaggtcagtggttagaagcagaagaggataatgatactgaaagtggtgatgatgaagacggtgaagaattagatacagaagatgaagaaatggaaaacaatctaaatccaaaaccaccaagaaggaaaagcagacggcgaatattttgtcagctaatgcaccacctcactgaaaaccacaagatatggaaggaaatcgtagaggaagaagaaaaatgtaaagctgatgggaataaactgcaggtggagaattcctccttacctcaagcagatgagattcaggtaattgaagaggcagatgaagaggaatagcgacagtttgagtaaaagaaaagtcatattgaagaagcccagagggttgtgcccaggggcagaaatcattgcctagtgttcaccggctgactctcaactgaccattcccatgtggacaggccttaatactgtgagaggatccttgctctgctggcagtttcccactcctatgcactttcacaggaactagaaaactattcttaaaccaaaaataccatccgtgttgacccatgttgcagagcccttacttaaatccttcactggtgtatgaatactttgtcataatgctgctttgctgggtagtgagctcttatttttcactgggggtcagctataactaaaaactcaagtgacatatttcagttaccaaagtggccaggaactttttgcttttatgaaaatagattcatattgtatttcccagtgtgtcttttatgtctttgaatgttttggagaaaagtctatgcctgtctaaaaatgaatccagtgttgcctttctgagggatttctgctcaatgcaatacactgttcagtgctattctcccagctaggtttatccatgaaggactgagtgacctttgttgtatttaacaaaatccaggtgcatcaatttctgatgctttttactattgtgtattatctactatgtgtgttttatttctgctgagagtattcaggtttgccatggacatcagaagtttgaattccagtcttatcttatgttccatggctgaattttaaagctgtttaggtttaacaatgaagggatttattctttagtcaaaattgttgtttttactctagctcaggattcgtatttttaaagatttagttaatataaacacagcacagatttgtcagaagaaaaaaaatttgctgtaataccaaaactaacctcatcaaagatacagaaaaaaagaaatatagtgagccctaaaggacacatacattgaataaataattggaacatgtggttatctttagatccacatcttagctgtcatttgttcactctaaaactgatgttcatctttctgttaatttccctctgcctaaagactacatgacagaaatgacctatcactacttattatttctgaagcctaactgcaagactgatttctgagaacaagtaaagaactggaatacttatttttcatataaaaatctaaatgtgttaataaatcatttcatacaaaagtacattattaaataaccacattattaaaataattgcaagaaaatggaccatatttacaatgttttgtaaacttgctagtgtgtggatatgtaccctacttgtgaaatacatttgaagatataaagagcagccaaaatgatggcaaaatggtaggctaatattttctattattattggagaacatatcatattttggaatcatgcaattttgcacacagtgaaaccattaattttccaaggtaattcctttagaatatggtattggcatgcagtttcttacttatctagaatatttggcttatctgaaagatatcaatttaagatctctggaagtgttagaatttttgatccttcacagtgtcaatatttaatgaatcactaagctttatttattagacgtgttgagtgagtgctgagttccttgctgccacttttgttaccattgtcacacactatgtgtaaaccagtcccaccacttattactaataaaattttgactgataatttatatttgcacttacaatatatatatcctgtccttatatttctctagagtacattttccatcatgtttaagtgtatttctgctattatttcctctcctgcagaatacatacaagtgtatgtgtataaagtcatacatgtacaagcatgcatattgagattgaatcacatttccatactgtctgttattttattgggttttatattgggtttctttagtttatgttgttttctcaaaagcagcattttaaattacgaatactggacttattggatttaattataaatccaattactactggaaactcatttttacataatatagtccttaaattatttaacccttgctaagtaattgacatatgtaacaataactagcctaaagaaacccaaaaaagtatctctcccgagctgaaacttaaaaattcgtaagtgtaagaaagaatgtgagaatatattaaatgcacactgtaccattagatgaaatcttacttgagaaattgccataagccatattacagatcttactttgttactgaatcagattaatttcttgttataataattttcatcataaattttctatttttaaagccgctggtactagaaatattcttttaatgctatatctatgtacctactgacacatttttctccataaaagtacttttaaaaattacttcatgatttg

SEQ ID NO: 307202 - DNA, 4475 bp, Homo sapiens
atgaggagggacgagcgagacgccaaagccatgcggtccctgcagccgccggatggggccggctcgccccccgagagtctgaggaacggctacgtgaagagctgcgtgagccccttgcggcaggaccctccgcgcggcttcttcttccacctctgccgcttctgcaacgtggagctgcggccgccgccggcctctccccagcagccgcggcgctgctcccccttctgccgggcgcgcctctcgctgggcgccctggctgcctttgtcctcgccctgctgctgggcgcggaacccgagagctgggctgccggggccgcctggctgcggacgctgctgagcgtgtgttcgcacagcttgagccccctcttcagcatcgcctgtgccttcttcttcctcacctgcttcctcacccggaccaagcggggacccggcccgggccggagctgcggctcctggtggctgctggcgctgcccgcctgctgttacctgggggacttcttggtgtggcagtggtggtcttggccttggggggatggcgacgcagggtccgcggccccgcacacgcccccggaggcggcagcgggcaggttgctgctggtgctgagctgcgtagggctgctgctgacgctcgcgcacccgctgcggctccggcactgcgttctggtgctgctcctggccagcttcgtctggtgggtctccttcaccagcctcgggtcgctgccctccgccctcaggccgctgctctccggcctggtggggggcgctggctgcctgctggccctggggttggatcacttctttcaaatcagggaagcgcctcttcatcctcgactgtccagtgccgccgaagaaaaagtgcctgtgatccgaccccggaggaggtccagctgcgtgtcgttaggagaaactgcagccagttactatggcagttgcaaaatattcaggagaccgtcgttgccttgtatttccagagaacagatgattctttgggattgggacttaaaacaatggtataagcctcattatcaaaattctggaggtggaaatggagttgatctttcagtgctaaatgaggctcgcaatatggtgtcagatcttctgactgatccaagccttccaccacaagtcatttcctctctacggagtattagtagcttaatgggtgctttctcaggttcctgtaggccaaagattaatcctctcacaccatttcctggattttacccctgttctgaaatagaggacccagctgagaaaggggatagaaaacttaacaagggactaaataggaatagtttgccaactccacagctgaggagaagctcaggaacttcaggattgctacctgttgaacagtcttcaaggtgggatcgtaataatggcaaaaggcctcaccaagaatttggcatttcaagtcaaggatgctatctaaatgggccttttaattcaaatctactgactatcccgaagcaaaggtcatcttctgtatcactgactcaccatgtaggtctcagaagagctggtgttttgtccagtctgagtcctgtgaattcttccaaccatggaccagtgtctactggctctctaactaatcgatcacccatagaatttcctgatactgctgattttcttaataagccaagcgttatcttgcagagatctctgggcaatgcacctaatactccagatttttatcagcaacttagaaattctgatagcaatctgtgtaacagctgtggacatcaaatgctgaaatatgtttcaacatctgaatcagatggtacagattgctgcagtggaaaatcaggtgaagaagaaaacattttctcgaaagaatcattcaaacttatggaaactcaacaagaagaggaaacagagaagaaagacagcagaaaattatttcaggaaggtgataagtggctaacagaagaggcacagagtgaacagcaaacaaatattgaacaggaagtatcactggacctgattttagtagaagagtatgactcattaatagaaaagatgagcaactggaattttccaatttttgaacttgtagaaaagatgggagagaaatcaggaaggattctcagtcaggttatgtataccttatttcaagacactggtttattggaaatatttaaaattcccactcaacaatttatgaactattttcgtgcattagaaaatggctatcgagacattccttatcacaatcgtatacatgccacagatgtgctacatgcagtttggtatctgacaacacggccagttcctggcttacagcagatccacaatggttgtggaacaggaaatgaaacagattctgatggtagaattaaccatgggcgaattgcttatatttcttcgaagagctgctctaatcctgatgagagttatggctgcctgtcttcaaacattcctgcattagaattgatggctctatacgtggcagctgccatgcatgattatgatcacccagggaggacaaatgcatttctagtggctacaaatgcccctcaggcagttttatacaatgacagatctgttctggaaaatcatcatgctgcgtcagcttggaatctatatctttctcgcccagaatacaacttccttcttcatcttgatcatgtggaattcaagcgctttcgttttttagtcattgaagcaatccttgctacggatcttaaaaagcattttgattttctcgcagaattcaatgccaaggcaaatgatgtaaatagtaatggcatagaatggagtaatgaaaatgatcgcctcttggtatgccaggtgtgcatcaaactggcagatataaatggcccagcaaaagttcgagacttgcatttgaaatggacagaaggcattgtcaatgaattttatgagcagggagatgaagaagcaaatcttggtctgcccatcagtccattcatggatcgttcttctcctcaactagcaaaactccaagaatcttttatcacccacatagtgggtcccctgtgtaactcctatgatgctgctggtttgctaccaggtcagtggttagaagcagaagaggataatgatactgaaagtggtgatgatgaagacggtgaagaattagatacagaagatgaagaaatggaaaacaatctaaatccaaaaccaccaagaaggaaaagcagacggcgaatattttgtcagctaatgcaccacctcactgaaaaccacaagatatggaaggaaatcgtagaggaagaagaaaaatgtaaagctgatgggaataaactgcaggtggagaattcctccttacctcaagcagatgagattcaggtaattgaagaggcagatgaagaggaatagcgacagtttgagtaaaagaaaagtcatattgaagaagcccagagggttgtgcccaggggcagaaatcattgcctagtgttcaccggctgactctcaactgaccattcccatgtggacaggccttaatactgtgagaggatccttgctctgctggcagtttcccactcctatgcactttcacaggaactagaaaactattcttaaaccaaaaataccatccgtgttgacccatgttgcagagcccttacttaaatccttcactggtgtatgaatactttgtcataatgctgctttgctgggtagtgagctcttatttttcactgggggtcagctataactaaaaactcaagtgacatatttcagttaccaaagtggccaggaactttttgcttttatgaaaatagattcatattgtatttcccagtgtgtcttttatgtctttgaatgttttggagaaaagtctatgcctgtctaaaaatgaatccagtgttgcctttctgagggatttctgctcaatgcaatacactgttcagtgctattctcccagctaggtttatccatgaaggactgagtgacctttgttgtatttaacaaaatccaggtgcatcaatttctgatgctttttactattgtgtattatctactatgtgtgttttatttctgctgagagtattcaggtttgccatggacatcagaagtttgaattccagtcttatcttatgttccatggctgaattttaaagctgtttaggtttaacaatgaagggatttattctttagtcaaaattgttgtttttactctagctcaggattcgtatttttaaagatttagttaatataaacacagcacagatttgtcagaagaaaaaaaatttgctgtaataccaaaactaacctcatcaaagatacagaaaaaaagaaatatagtgagccctaaaggacacatacattgaataaataattggaacatgtggttatcttccaaaaaaaaaaaaaaaaaataaaacacaaaaaacttgtgttggggcgcgcccttgggccctgaaaaaagcttttctaacccctttgcgttgtgggccgggggggccccttgggttggtgtgaccctggggcccagggggttccccagggaaaag

SEQ ID NO: 307203 - DNA, 392 bp, Homo sapiens
taaactttaatatctttgaggtgtctgcctcatttttctatatttctttttaggcagttttatacaatgacagatctgttctggaaaatcatcatgctgcgtcagcttggaatctatatctttctcgcccagaatacaacttccttcttcatcttgatcatgtggaattcaagcgctttcgttttttagtcattgaagcaatccttgctacggatcttaaaaagcattttgattttctcgcagaattcaatgccaaggtttgttatgaaaattagtgcctgatttaaaaaatctttattgtcagtgttactgataaaatatgttttttaatgttaagttagaattattactacttaggaagtaacaataaatagttgatataaaataatata

SEQ ID NO: 307204 - DNA, 769 bp, Homo sapiens
gtaattgtgtttaattcaatacataagaatgcccttaaaggttggtttttaactttgggttattttcatttgaaatttcagcacgcttcttccctctccaccatacccagccagttttccctaaacctcttctctattttgtttttatccgtaacaataccatctaacatattcctgttttgcttctttctgttttcctagctctttccactagaatctgaacaccataacgcagggattatttttatagtactatttcattatattatttttattatactattattttatagtactgtttacttttatactcccagtgcttagatacctagaataggcacttaatatttgttgaatgattaaatcatattgctatgattagaatatatttattttaaatttcacagaaccaccaagaaggaaaagcagacggcgaatattttgtcagctaatgcaccacctcactgaaaaccacaagatatggaaggaaatcgtagaggaagaagaaaaatgtaaagctgatgggaataaactgcaggtggagaattcctccttacctcaagcagatgagattcaggtaattgaagaggcagatgaagaggaatagcgacagtttgagtaaaagaaaagtcatattgaagaagcccagagggttgtgcccaggggcagaaatcattgcctagtgttcaccggctgactctcaactgaccattcccatgtggacaggccttaatactgtgagaggatccttgctctgctggcagtttcc

SEQ ID NO: 307205 - DNA, 2066 bp, Homo sapiens
gtagccctcacgtgaccaagagctgacgtgtgcagaagtccttcttgtcctggtcgttgttcccgtctgagtaccagctccccactgccctgagggcgggccggcctgcggcggagggaaaaaggaagaggagaaggaaattgtcccgaatccctgcagtgggtccaagcctctcccgggtggccagtctttctgtaggttgcggcacaacgccaggcaaaagaagaggaaggaatttaatcctaatcggtggaggtcgatttgagggtctgctgtagcaggtggctccgcttgaagcgagggaggaagtttcctccgatcagtagagattggaaagattgttgggagtggcacaccactagggaaaagaagaaggggcgaactgcttgtcttgaggaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaagaaaccaaacttcaggttctgaaactccttttgaatttggctgaaaatccagccatgactagggaactgctcagggcccaagtaccatcttcactgggctccctctttaataagaaggagaacaaagaagttattcttaaacttctggtcatatttgagaacataaatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaatatcatattgtatcatcaatgctgatatttaactgagttggtctttaggtttaagatggataaatgaatatcactacttgttctgaaaacatgtttgttgctttttatctcgctgcctagattgaaatattttgctatttcttctgcataagtgacagtgaaccaattcatcatgagtaagctcccttctgtcattttcattgatttaatttgtgtatcatcaataaaattgtatgttaatgctggaaagaaaaaaagaagaaagaaagaaac

SEQ ID NO: 307206 - DNA, 2039 bp, Homo sapiens
gtagccctcacgtgaccaagagctgacgtgtgcagaagtccttcttgtcctggtcgttgttcccgtctgagtaccagctccccactgccctgagggcgggccggcctgcggcggagggaaaaaggaagaggagaaggaaattgtcccgaatccctgcaggtctttctgtaggttgcggcacaacgccaggcaaaagaagaggaaggaatttaatcctaatcggtggaggtcgatttgagggtctgctgtagcaggtggctccgcttgaagcgagggaggaagtttcctccgatcagtagagattggaaagattgttgggagtggcacaccactagggaaaagaagaaggggcgaactgcttgtcttgaggaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaagaaaccaaacttcaggttctgaaactccttttgaatttggctgaaaatccagccatgactagggaactgctcagggcccaagtaccatcttcactgggctccctctttaataagaaggagaacaaagaagttattcttaaacttctggtcatatttgagaacataaatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaatatcatattgtatcatcaatgctgatatttaactgagttggtctttaggtttaagatggataaatgaatatcactacttgttctgaaaacatgtttgttgctttttatctcgctgcctagattgaaatattttgctatttcttctgcataagtgacagtgaaccaattcatcatgagtaagctcccttctgtcattttcattgatttaatttgtgtatcatcaataaaattgtatgttaatgctggaaagaaaaaaagaagaaagaaagaaac

SEQ ID NO: 307207 - DNA, 2801 bp, Homo sapiens
gtagccctcacgtgaccaagagctgacgtgtgcagaagtccttcttgtcctggtcgttgttcccgtctgagtaccagctccccactgccctgagggcgggccggcctgcggcggagggaaaaaggaagaggagaaggaaattgtcccgaatccctgcagtgggtccaagcctctcccgggtggccagtctttctgtaggttgcggcacaacgccaggcaaaagaagaggaaggaatttaatcctaatcggtggaggtcgatttgagggtctgctgtagcaggtggctccgcttgaagcgagggaggaagtttcctccgatcagtagagattggaaagattgttgggagtggcacaccactagggaaaagaagaaggggcgaactgcttgtcttgaggaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaagaaaccaaacttcaggttctgaaactccttttgaatttggctgaaaatccagccatgactagggaactgctcagggcccaagtaccatcttcactgggctccctctttaataagaaggagaacaaagaagttattcttaaacttctggtcatatttgagaacataaatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaatatcatattgtatcatcaatgctgatatttaactgagttggtctttaggtttaagatggataaatgaatatcactacttgttctgaaaacatgtttgttgctttttatctcgctgcctagattgaaatattttgctatttcttctgcataagtgacagtgaaccaattcatcatgagtaagctcccttctgtcattttcattgatttaatttgtgtatcatcaataaaattgtatgttaatgctggaaagaaaaaaagaagaaagaaagaaaccatccctgtccttcagtttataatctagttggagagataagaaacgtacaaaccaaaagataacagaatatctgaagcatgtactcattgtcagatgttccctctgagagcacagaggaggcaaaagcttctgtgggatgtgctagtcggctaaagcttcacagaggaggtggcaattgaaaatgagtcctgaatggggtagggtggttagggaattccatgagacaagacaaggggggcatggtgtgagaaaggcatggaagtaggaaccctcttcctatgacaggagatcattctgcttggactgcaccaaggacttcccttgacagttgtgcttctggttgaatttggccaatggagaggccattcaggaaagcagaaagaaaaaggagagtgaagatggaatacttacttgaagtatttatctggatggtgcctctcaaacaaaagtccaattcccatgggatgccttctccaaacagctatatttctagcttctctccttccccttttagacctaggactgccaaagcttccctattgctgctagtcatggagtactgcactaccgcctgtagtttcccttcactctatccacgcatttcatgaactctcttcaaattactcaatatgggtagccatcgacttcttaccaaggccctgactgagacactttcattcttttaaaaatatccgagtcaactaatatattaaaatagaccagcatctcttctc

SEQ ID NO: 307208 - DNA, 3383 bp, Homo sapiens
gtagccctcacgtgaccaagagctgacgtgtgcagaagtccttcttgtcctggtcgttgttcccgtctgagtaccagctccccactgccctgagggcgggccggcctgcggcggagggaaaaaggaagaggagaaggaaattgtcccgaatccctgcaggtctttctgtaggttgcggcacaacgccaggcaaaagaagaggaaggaatttaatcctaatcggtggaggtcgatttgagggtctgctgtagcaggtggctccgcttgaagcgagggaggaagtttcctccgatcagtagagattggaaagattgttgggagtggcacaccactagggaaaagaagaaggggcgaactgcttgtcttgaggaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaagaaaccaaacttcaggttctgaaactccttttgaatttggctgaaaatccagccatgactagggaactgctcagggcccaagtaccatcttcactgggctccctctttaataagaaggagaacaaagaagttattcttaaacttctggtcatatttgagaacataaatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaatatcatattgtatcatcaatgctgatatttaactgagttggtctttaggtttaagatggataaatgaatatcactacttgttctgaaaacatgtttgttgctttttatctcgctgcctagattgaaatattttgctatttcttctgcataagtgacagtgaaccaattcatcatgagtaagctcccttctgtcattttcattgatttaatttgtgtatcatcaataaaattgtatgttaatgctggaaagaaaaaaagaagaaagaaagaaaccatccctgtccttcagtttataatctagttggagagataagaaacgtacaaaccaaaagataacagaatatctgaagcatgtactcattgtcagatgttccctctgagagcacagaggaggcaaaagcttctgtgggatgtgctagtcggctaaagcttcacagaggaggtggcaattgaaaatgagtcctgaatggggtagggtggttagggaattccatgagacaagacaaggggggcatggtgtgagaaaggcatggaagtaggaaccctcttcctatgacaggagatcattctgcttagagtggagagtgtggagagtgggagtagataattttggaaagctgggtgaagccagttgtggagaattgtttgaatattatcccattgaatacccagagccactaaatctttttttactagaaaataattggggtccatatgaaagtctctattactgagtagtgtcaatgagggtgtggcaaaatggagcctttcacatcctagtggtggccatttggtaatacagatataagccttaaactatgtaaacccttgtcctaaggaagtaattgaataattgcccaaagattgtatgtatgaggctgttcatcccagcactgtctaagctagtaaaaattggaaacaatttaagtatctagcacattggattggttataaagcaaggaatgttcacacagtaggatattataagtatgctgatggaaatctatattgccaggaaaagctattcattatgcgttgtgaagtcagaaagtaaaaaagggtagatagaagtattcgaagtatagttccattttttgagactaataaaacatatgtttaaaaggacactaaaaactggagttatagatatccagatagaaacagtagttatctttgggtagaagaataatgagtgatctttacttttttactttttattcatctttgtgtttttatttatctaaaatgggtattgatttttaggacggttttgaaaaagaaaagtgttgggaatgaagcaagtgattgattggaaaacatactgaatggaagaaatatttagattaaaaatgaggtaggttgaagtttcttctctgaaatgatagataaatggtgaagataaggcttattgtgaggattcagtgaggtaatatatgcaaagtacttacaatgttctggcacatagtaattaattaagaaaatcgagcacccttaattacctagaatgcagggttgttagttttttggttgacttttgttttgctggggcattctgccatgttttagtgtcatttaataaataatagtaacaataaaggttaacatttattaagtgac

SEQ ID NO: 307209 - DNA, 3268 bp, Homo sapiens
aggctggtacggacccaggagatttaaattgtcccgaatccctggtctttctgtaggttgcggcacaacgccaggcaaaagaagaggaaggaatttaatcctaatcggtggaggtcgatttgagggtctgctgtagcaggtggctccgcttgaagcgagggaggaagtttcctccgatcagtagagattggaaagattgttgggagtggcacaccactagggaaaagaagaaggggcgaactgcttgtcttgaggaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaagaaaccaaacttcaggttctgaaactccttttgaatttggctgaaaatccagccatgactagggaactgctcagggcccaagtaccatcttcactgggctccctctttaataagaaggagaacaaagaagttattcttaaacttctggtcatatttgagaacataaatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaatatcatattgtatcatcaatgctgatatttaactgagttggtctttaggtttaagatggataaatgaatatcactacttgttctgaaaacatgtttgttgctttttatctcgctgcctagattgaaatattttgctatttcttctgcataagtgacagtgaaccaattcatcatgagtaagctcccttctgtcattttcattgatttaatttgtgtatcatcaataaaattgtatgttaatgctggaaagaaaaaaagaagaaagaaagaaaccatccctgtccttcagtttataatctagttggagagataagaaacgtacaaaccaaaagataacagaatatctgaagcatgtactcattgtcagatgttccctctgagagcacagaggaggcaaaagcttctgtgggatgtgctagtcggctaaagcttcacagaggaggtggcaattgaaaatgagtcctgaatggggtagggtggttagggaattccatgagacaagacaaggggggcatggtgtgagaaaggcatggaagtaggaaccctcttcctatgacaggagatcattctgcttagagtggagagtgtggagagtgggagtagataattttggaaagctgggtgaagccagttgtggagaattgtttgaatattatcccattgaatacccagagccactaaatctttttttactagaaaataattggggtccatatgaaagtctctattactgagtagtgtcaatgagggtgtggcaaaatggagcctttcacatcctagtggtggccatttggtaatacagatataagccttaaactatgtaaacccttgtcctaaggaagtaattgaataattgcccaaagattgtatgtatgaggctgttcatcccagcactgtctaagctagtaaaaattggaaacaatttaagtatctagcacattggattggttataaagcaaggaatgttcacacagtaggatattataagtatgctgatggaaatctatattgccaggaaaagctattcattatgcgttgtgaagtcagaaagtaaaaaagggtagatagaagtattcgaagtatagttccattttttgagactaataaaacatatgtttaaaaggacactaaaaactggagttatagatatccagatagaaacagtagttatctttgggtagaagaataatgagtgatctttacttttttactttttattcatctttgtgtttttatttatctaaaatgggtattgatttttaggacggttttgaaaaagaaaagtgttgggaatgaagcaagtgattgattggaaaacatactgaatggaagaaatatttagattaaaaatgaggtaggttgaagtttcttctctgaaatgatagataaatggtgaagataaggcttattgtgaggattcagtgaggtaatatatgcaaagtacttacaatgttctggcacatagtaattaattaagaaaatcgagcacccttaattacctagaatgcagggttgttagttttttggttgacttttgttttgctggggcattctgccatgttttagtgtcatttaataaataatagtaacaataaaggttaacatttattaagtgac

SEQ ID NO: 307210 - DNA, 3339 bp, Homo sapiens
tttgagacccgttggatcccccgggctgcttgaattcggcactacctgagggcgggccggcctgcggcggagggaaaaaggaagaggagaaggaaattgtcccgaatccctgcaggtctttctgtaggttgcggcacaacgccaggcaaaagaagaggaaggaatttaatcctaatcggtggaggtcgatttgagggtctgctgtagcaggtggctccgcttgaagcgagggaggaagtttcctccgatcagtagagattggaaagattgttgggagtggcacaccactagggaaaagaagaaggggcgaactgcttgtcttgaggaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaagaaaccaaacttcaggttctgaaactccttttgaatttggctgaaaatccagccatgactagggaactgctcagggcccaagtaccatcttcactgggctccctctttaataagaaggagaacaaagaagttattcttaaacttctggtcatatttgagaacataaatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaatatcatattgtatcatcaatgctgatatttaactgagttggtctttaggtttaagatggataaatgaatatcactacttgttctgaaaacatgtttgttgctttttatctcgctgcctagattgaaatattttgctatttcttctgcataagtgacagtgaaccaattcatcatgagtaagctcccttctgtcattttcattgatttaatttgtgtatcatcaataaaattgtatgttaatgctggaaagaaaaaaagaagaaagaaagaaaccatccctgtccttcagtttataatctagttggagagataagaaacgtacaaaccaaaagataacagaatatctgaagcatgtactcattgtcagatgttccctctgagagcacagaggaggcaaaagcttctgtgggatgtgctagtcggctaaagcttcacagaggaggtggcaattgaaaatgagtcctgaatggggtagggtggttagggaattccatgagacaagacaaggggggcatggtgtgagaaaggcatggaagtaggaaccctcttcctatgacaggagatcattctgcttagagtggagagtgtggagagtgggagtagataattttggaaagctgggtgaagccagttgtggagaattgtttgaatattatcccattgaatacccagagccactaaatctttttttactagaaaataattggggtccatatgaaagtctctattactgagtagtgtcaatgagggtgtggcaaaatggagcctttcacatcctagtggtggccatttggtaatacagatataagccttaaactatgtaaacccttgtcctaaggaagtaattgaataattgcccaaagattgtatgtatgaggctgttcatcccagcactgtctaagctagtaaaaattggaaacaatttaagtatctagcacattggattggttataaagcaaggaatgttcacacagtaggatattataagtatgctgatggaaatctatattgccaggaaaagctattcattatgcgttgtgaagtcagaaagtaaaaaagggtagatagaagtattcgaagtatagttccattttttgagactaataaaacatatgtttaaaaggacactaaaaactggagttatagatatccagatagaaacagtagttatctttgggtagaagaataatgagtgatctttacttttttactttttattcatctttgtgtttttatttatctaaaatgggtattgatttttaggacggttttgaaaaagaaaagtgttgggaatgaagcaagtgattgattggaaaacatactgaatggaagaaatatttagattaaaaatgaggtaggttgaagtttcttctctgaaatgatagataaatggtgaagataaggcttattgtgaggattcagtgaggtaatatatgcaaagtacttacaatgttctggcacatagtaattaattaagaaaatcgagcacccttaattacctagaatgcagggttgttagttttttggttgacttttgttttgctggggcattctgccatgttttagtgtcatttaataaataatagtaacaataaaggttaacatttattaagtgac

SEQ ID NO: 307211 - DNA, 3322 bp, Homo sapiens
gtagccctcacgtgaccaagagctgacgtgtgcagaagtccttcttgtcctggtcgttgttcccgtctgagtaccagctccccactgccctgagggcgggccggcctgcggcggagggaaaaaggaagaggagaaggaaattgtcccgaatccctgcaggtctttctgtaggttgcggcacaacgccaggcaaaagaagaggaaggaatttaatcctaatcggtggaggtcgatttgaggattggaaagattgttgggagtggcacaccactagggaaaagaagaaggggcgaactgcttgtcttgaggaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaagaaaccaaacttcaggttctgaaactccttttgaatttggctgaaaatccagccatgactagggaactgctcagggcccaagtaccatcttcactgggctccctctttaataagaaggagaacaaagaagttattcttaaacttctggtcatatttgagaacataaatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaatatcatattgtatcatcaatgctgatatttaactgagttggtctttaggtttaagatggataaatgaatatcactacttgttctgaaaacatgtttgttgctttttatctcgctgcctagattgaaatattttgctatttcttctgcataagtgacagtgaaccaattcatcatgagtaagctcccttctgtcattttcattgatttaatttgtgtatcatcaataaaattgtatgttaatgctggaaagaaaaaaagaagaaagaaagaaaccatccctgtccttcagtttataatctagttggagagataagaaacgtacaaaccaaaagataacagaatatctgaagcatgtactcattgtcagatgttccctctgagagcacagaggaggcaaaagcttctgtgggatgtgctagtcggctaaagcttcacagaggaggtggcaattgaaaatgagtcctgaatggggtagggtggttagggaattccatgagacaagacaaggggggcatggtgtgagaaaggcatggaagtaggaaccctcttcctatgacaggagatcattctgcttagagtggagagtgtggagagtgggagtagataattttggaaagctgggtgaagccagttgtggagaattgtttgaatattatcccattgaatacccagagccactaaatctttttttactagaaaataattggggtccatatgaaagtctctattactgagtagtgtcaatgagggtgtggcaaaatggagcctttcacatcctagtggtggccatttggtaatacagatataagccttaaactatgtaaacccttgtcctaaggaagtaattgaataattgcccaaagattgtatgtatgaggctgttcatcccagcactgtctaagctagtaaaaattggaaacaatttaagtatctagcacattggattggttataaagcaaggaatgttcacacagtaggatattataagtatgctgatggaaatctatattgccaggaaaagctattcattatgcgttgtgaagtcagaaagtaaaaaagggtagatagaagtattcgaagtatagttccattttttgagactaataaaacatatgtttaaaaggacactaaaaactggagttatagatatccagatagaaacagtagttatctttgggtagaagaataatgagtgatctttacttttttactttttattcatctttgtgtttttatttatctaaaatgggtattgatttttaggacggttttgaaaaagaaaagtgttgggaatgaagcaagtgattgattggaaaacatactgaatggaagaaatatttagattaaaaatgaggtaggttgaagtttcttctctgaaatgatagataaatggtgaagataaggcttattgtgaggattcagtgaggtaatatatgcaaagtacttacaatgttctggcacatagtaattaattaagaaaatcgagcacccttaattacctagaatgcagggttgttagttttttggttgacttttgttttgctggggcattctgccatgttttagtgtcatttaataaataatagtaacaataaaggttaacatttattaagtgac

SEQ ID NO: 307212 - DNA, 3177 bp, Homo sapiens
gctcgggaccctctaagcatcactccccgtgagggtctgctgtagcaggtggctccgcttgaagcgagggaggaagtttcctccgatcagtagagattggaaagattgttgggagtggcacaccactagggaaaagaagaaggggcgaactgcttgtcttgaggaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaagaaaccaaacttcaggttctgaaactccttttgaatttggctgaaaatccagccatgactagggaactgctcagggcccaagtaccatcttcactgggctccctctttaataagaaggagaacaaagaagttattcttaaacttctggtcatatttgagaacataaatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaatatcatattgtatcatcaatgctgatatttaactgagttggtctttaggtttaagatggataaatgaatatcactacttgttctgaaaacatgtttgttgctttttatctcgctgcctagattgaaatattttgctatttcttctgcataagtgacagtgaaccaattcatcatgagtaagctcccttctgtcattttcattgatttaatttgtgtatcatcaataaaattgtatgttaatgctggaaagaaaaaaagaagaaagaaagaaaccatccctgtccttcagtttataatctagttggagagataagaaacgtacaaaccaaaagataacagaatatctgaagcatgtactcattgtcagatgttccctctgagagcacagaggaggcaaaagcttctgtgggatgtgctagtcggctaaagcttcacagaggaggtggcaattgaaaatgagtcctgaatggggtagggtggttagggaattccatgagacaagacaaggggggcatggtgtgagaaaggcatggaagtaggaaccctcttcctatgacaggagatcattctgcttagagtggagagtgtggagagtgggagtagataattttggaaagctgggtgaagccagttgtggagaattgtttgaatattatcccattgaatacccagagccactaaatctttttttactagaaaataattggggtccatatgaaagtctctattactgagtagtgtcaatgagggtgtggcaaaatggagcctttcacatcctagtggtggccatttggtaatacagatataagccttaaactatgtaaacccttgtcctaaggaagtaattgaataattgcccaaagattgtatgtatgaggctgttcatcccagcactgtctaagctagtaaaaattggaaacaatttaagtatctagcacattggattggttataaagcaaggaatgttcacacagtaggatattataagtatgctgatggaaatctatattgccaggaaaagctattcattatgcgttgtgaagtcagaaagtaaaaaagggtagatagaagtattcgaagtatagttccattttttgagactaataaaacatatgtttaaaaggacactaaaaactggagttatagatatccagatagaaacagtagttatctttgggtagaagaataatgagtgatctttacttttttactttttattcatctttgtgtttttatttatctaaaatgggtattgatttttaggacggttttgaaaaagaaaagtgttgggaatgaagcaagtgattgattggaaaacatactgaatggaagaaatatttagattaaaaatgaggtaggttgaagtttcttctctgaaatgatagataaatggtgaagataaggcttattgtgaggattcagtgaggtaatatatgcaaagtacttacaatgttctggcacatagtaattaattaagaaaatcgagcacccttaattacctagaatgcagggttgttagttttttggttgacttttgttttgctggggcattctgccatgttttagtgtcatttaataaataatagtaacaataaaggttaacatttattaagtgac

SEQ ID NO: 307213 - DNA, 3185 bp, Homo sapiens
tgacctgggatggggagggaaaggctgaaatgagaggcatagagatttcgtcaacaatctacatttcctacctagcattcaattattattatcttgtccctctgtgcagctccctgcatggggcaacacaagcagaagagaaactcaaacccaattttcttcttccactcctaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaagaaaccaaacttcaggttctgaaactccttttgaatttggctgaaaatccagccatgactagggaactgctcagggcccaagtaccatcttcactgggctccctctttaataagaaggagaacaaagaagttattcttaaacttctggtcatatttgagaacataaatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaatatcatattgtatcatcaatgctgatatttaactgagttggtctttaggtttaagatggataaatgaatatcactacttgttctgaaaacatgtttgttgctttttatctcgctgcctagattgaaatattttgctatttcttctgcataagtgacagtgaaccaattcatcatgagtaagctcccttctgtcattttcattgatttaatttgtgtatcatcaataaaattgtatgttaatgctggaaagaaaaaaagaagaaagaaagaaaccatccctgtccttcagtttataatctagttggagagataagaaacgtacaaaccaaaagataacagaatatctgaagcatgtactcattgtcagatgttccctctgagagcacagaggaggcaaaagcttctgtgggatgtgctagtcggctaaagcttcacagaggaggtggcaattgaaaatgagtcctgaatggggtagggtggttagggaattccatgagacaagacaaggggggcatggtgtgagaaaggcatggaagtaggaaccctcttcctatgacaggagatcattctgcttagagtggagagtgtggagagtgggagtagataattttggaaagctgggtgaagccagttgtggagaattgtttgaatattatcccattgaatacccagagccactaaatctttttttactagaaaataattggggtccatatgaaagtctctattactgagtagtgtcaatgagggtgtggcaaaatggagcctttcacatcctagtggtggccatttggtaatacagatataagccttaaactatgtaaacccttgtcctaaggaagtaattgaataattgcccaaagattgtatgtatgaggctgttcatcccagcactgtctaagctagtaaaaattggaaacaatttaagtatctagcacattggattggttataaagcaaggaatgttcacacagtaggatattataagtatgctgatggaaatctatattgccaggaaaagctattcattatgcgttgtgaagtcagaaagtaaaaaagggtagatagaagtattcgaagtatagttccattttttgagactaataaaacatatgtttaaaaggacactaaaaactggagttatagatatccagatagaaacagtagttatctttgggtagaagaataatgagtgatctttacttttttactttttattcatctttgtgtttttatttatctaaaatgggtattgatttttaggacggttttgaaaaagaaaagtgttgggaatgaagcaagtgattgattggaaaacatactgaatggaagaaatatttagattaaaaatgaggtaggttgaagtttcttctctgaaatgatagataaatggtgaagataaggcttattgtgaggattcagtgaggtaatatatgcaaagtacttacaatgttctggcacatagtaattaattaagaaaatcgagcacccttaattacctagaatgcagggttgttagttttttggttgacttttgttttgctggggcattctgccatgttttagtgtcatttaataaataatagtaacaataaaggttaacatttattaagtgac

SEQ ID NO: 307214 - DNA, 3063 bp, Homo sapiens
tccttgctcgagatccattgtgctctaaaggcgaactgcttgtcttgaggaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaagaaaccaaacttcaggttctgaaactccttttgaatttggctgaaaatccagccatgactagggaactgctcagggcccaagtaccatcttcactgggctccctctttaataagaaggagaacaaagaagttattcttaaacttctggtcatatttgagaacataaatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaatatcatattgtatcatcaatgctgatatttaactgagttggtctttaggtttaagatggataaatgaatatcactacttgttctgaaaacatgtttgttgctttttatctcgctgcctagattgaaatattttgctatttcttctgcataagtgacagtgaaccaattcatcatgagtaagctcccttctgtcattttcattgatttaatttgtgtatcatcaataaaattgtatgttaatgctggaaagaaaaaaagaagaaagaaagaaaccatccctgtccttcagtttataatctagttggagagataagaaacgtacaaaccaaaagataacagaatatctgaagcatgtactcattgtcagatgttccctctgagagcacagaggaggcaaaagcttctgtgggatgtgctagtcggctaaagcttcacagaggaggtggcaattgaaaatgagtcctgaatggggtagggtggttagggaattccatgagacaagacaaggggggcatggtgtgagaaaggcatggaagtaggaaccctcttcctatgacaggagatcattctgcttagagtggagagtgtggagagtgggagtagataattttggaaagctgggtgaagccagttgtggagaattgtttgaatattatcccattgaatacccagagccactaaatctttttttactagaaaataattggggtccatatgaaagtctctattactgagtagtgtcaatgagggtgtggcaaaatggagcctttcacatcctagtggtggccatttggtaatacagatataagccttaaactatgtaaacccttgtcctaaggaagtaattgaataattgcccaaagattgtatgtatgaggctgttcatcccagcactgtctaagctagtaaaaattggaaacaatttaagtatctagcacattggattggttataaagcaaggaatgttcacacagtaggatattataagtatgctgatggaaatctatattgccaggaaaagctattcattatgcgttgtgaagtcagaaagtaaaaaagggtagatagaagtattcgaagtatagttccattttttgagactaataaaacatatgtttaaaaggacactaaaaactggagttatagatatccagatagaaacagtagttatctttgggtagaagaataatgagtgatctttacttttttactttttattcatctttgtgtttttatttatctaaaatgggtattgatttttaggacggttttgaaaaagaaaagtgttgggaatgaagcaagtgattgattggaaaacatactgaatggaagaaatatttagattaaaaatgaggtaggttgaagtttcttctctgaaatgatagataaatggtgaagataaggcttattgtgaggattcagtgaggtaatatatgcaaagtacttacaatgttctggcacatagtaattaattaagaaaatcgagcacccttaattacctagaatgcagggttgttagttttttggttgacttttgttttgctggggcattctgccatgttttagtgtcatttaataaataatagtaacaataaaggttaacatttattaagtgac

SEQ ID NO: 307215 - DNA, 3891 bp, Homo sapiens
gtagccctcacgtgaccaagagctgacgtgtgcagaagtccttcttgtcctggtcgttgttcccgtctgagtaccagctccccactgccctgagggcgggccggcctgcggcggagggaaaaaggaagaggagaaggaaattgtcccgaatccctgcaggtctttctgtaggttgcggcacaacgccaggcaaaagaagaggaaggaatttaatcctaatcggtggaggtcgatttgagggtctgctgtagcaggtggctccgcttgaagcgagggaggaagtttcctccgatcagtagagattggaaagattgttgggagtggcacaccactagggaaaagaagaaggggcgaactgcttgtcttgaggaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaagaaaccaaacttcaggttctgaaactccttttgaatttggctgaaaatccagccatgactagggaactgctcagggcccaagtaccatcttcactgggctccctctttaataagaaggagaacaaagaagttattcttaaacttctggtcatatttgagaacataaatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaatatcatattgtatcatcaatgctgatatttaactgagttggtctttaggtttaagatggataaatgaatatcactacttgttctgaaaacatgtttgttgctttttatctcgctgcctagattgaaatattttgctatttcttctgcataagtgacagtgaaccaattcatcatgagtaagctcccttctgtcattttcattgatttaatttgtgtatcatcaataaaattgtatgttaatgctggaaagaaaaaaagaagaaagaaagaaaccatccctgtccttcagtttataatctagttggagagataagaaacgtacaaaccaaaagataacagaatatctgaagcatgtactcattgtcagatgttccctctgagagcacagaggaggcaaaagcttctgtgggatgtgctagtcggctaaagcttcacagaggaggtggcaattgaaaatgagtcctgaatggggtagggtggttagggaattccatgagacaagacaaggggggcatggtgtgagaaaggcatggaagtaggaaccctcttcctatgacaggagatcattctgcttagagtggagagtgtggagagtgggagtagataattttggaaagctgggtgaagccagttgtggagaattgtttgaatattatcccattgaatacccagagccactaaatctttttttactagaaaataattggggtccatatgaaagtctctattactgagtagtgtcaatgagggtgtggcaaaatggagcctttcacatcctagtggtggccatttggtaatacagatataagccttaaactatgtaaacccttgtcctaaggaagtaattgaataattgcccaaagattgtatgtatgaggctgttcatcccagcactgtctaagctagtaaaaattggaaacaatttaagtatctagcacattggattggttataaagcaaggaatgttcacacagtaggatattataagtatgctgatggaaatctatattgccaggaaaagctattcattatgcgttgtgaagtcagaaagtaaaaaagggtagatagaagtattcgaagtatagttccattttttgagactaataaaacatatgtttaaaaggacactaaaaactggagttatagatatccagatagaaacagtagttatctttgggtagaagaataatgagtgatctttacttttttactttttattcatctttgtgtttttatttatctaaaatgggtattgatttttaggacggttttgaaaaagaaaagtgttgggaatgaagcaagtgattgattggaaaacatactgaatggaagaaatatttagattaaaaatgagagacataagacataagagtctcattacgttgcccatgctggtatcgaactcctgggctcaagagatcctcccaccccagcctctgaattagctaggactacaggccagtgccagtacacccggctggctagaattttcttctttttaaaggctgcattgtttccattgtatttccatttgcatgtgccacattttctttatccatccaatgatggacacttaggttgattccacatcttggctattgtgaataatgctgcaatgaacatgggagtgaagatatctctttgatacactgatttcaattcctttgaatatatatgcagaagtgggattgctggataatatggtaattaaaattttagttttttgaggggcctccatactcttttccaaaatggctgtactaatttacattcccaccaacaatgttcaaggatttcatattcttgacattcttaccaaaattgtcacagtttgtaaaaggtagtctaataagtggcctaagtgaatgtgacaacacttcattgaaagcaatcttaggtttttccaactatagtcaataataacttaattgtacattctaaaataactcaaagagtgtaattggattgcttgtaacttaaaggataaatgcttgaggggatggatgcctcattctccatgatgtgcttatttcacattgcatgcctgtatcaaaacattacatttatcccataatatacacacttactatgtaccccccaaaaataaacattaaaattaagtttt

SEQ ID NO: 307216 - DNA, 3430 bp, Homo sapiens
gtagccctcacgtgaccaagagctgacgtgtgcagaagtccttcttgtcctggtcgttgttcccgtctgagtaccagctccccactgccctgagggcgggccggcctgcggcggagggaaaaaggaagaggagaaggaaattgtcccgaatccctgcaggtctttctgtaggttgcggcacaacgccaggcaaaagaagaggaaggaatttaatcctaatcggtggaggtcgatttgagggtctgctgtagcaggtggctccgcttgaagcgagggaggaagtttcctccgatcagtagagattggaaagattgttgggagtggcacaccactagggaaaagaagaaggggcgaactgcttgtcttgaggaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaagaaaccaaacttcaggttctgaaactccttttgaatttggctgaaaatccagccatgactagggaactgctcagggcccaagtaccatcttcactgggctccctctttaataagaaggagaacaaagaagttattcttaaacttctggtcatatttgagaacataaatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaatatcatattgtatcatcaatgctgatatttaactgagttggtctttaggtttaagatggataaatgaatatcactacttgttctgaaaacatgtttgttgctttttatctcgctgcctagattgaaatattttgctatttcttctgcataagtgacagtgaaccaattcatcatgagtaagctcccttctgtcattttcattgatttaatttgtgtatcatcaataaaattgtatgttaatgctggaaagaaaaaaagaagaaagaaagaaaccatccctgtccttcagtttataatctagttggagagataagaaacgtacaaaccaaaagataacagaatatctgaagcatgtactcattgtcagatgttccctctgagagcacagaggaggcaaaagcttctgtgggatgtgctagtcggctaaagcttcacagaggaggtggcaattgaaaatgagtcctgaatggggtagggtggttagggaattccatgagacaagacaaggggggcatggtgtgagaaaggcatggaagtaggaaccctcttcctatgacaggagatcattctgcttagagtggagagtgtggagagtgggagtagataattttggaaagctgggtgaagccagttgtggagaattgtttgaatattatcccattgaatacccagagccactaaatctttttttactagaaaataattggggtccatatgaaagtctctattactgagtagtgtcaatgagggtgtggcaaaatggagcctttcacatcctagtggtggccatttggtaatacagatataagccttaaactatgtaaacccttgtcctaaggaagtaattgaataattgcccaaagattgtatgtatgaggctgttcatcccagcactgtctaagctagtaaaaattggaaacaatttaagtatctagcacattggattggttataaagcaaggaatgttcacacagtaggatattataagtatgctgatggaaatctatattgccaggaaaagctattcattatgcgttgtgaagtcagaaagtaaaaaagggtagatagaagtattcgaagtatagttccattttttgagactaataaaacatatgtttaaaaggacactaaaaactggagttatagatatccagatagaaacagtagttatctttgggtagaagaataatgagtgatctttacttttttactttttattcatctttgtgtttttatttatctaaaatgggtattgatttttaggacggttttgaaaaagaaaagtgttgggaatgaagcaagtgattgattggaaaacatactgaatggaagaaatatttagattaaaaatgagaatggagataactttgagtacctagagaaggatggagctacaagatggaatgagcctgggaccctgaatggccacgtgtagcagagcctctctgctgacctggaacattaacctcagactcttttgagttgtgcaaccatcaccacaatgaattgtagaatattttcatcactccaaacagaaaccctgcacctatgagttgtcactcttcaacttgcctctgccactcctttcaactattactttactttctgtctctatagatttccctgttgtaaacatttcatataacattaaaaacttaagacca

SEQ ID NO: 307217 - DNA, 2139 bp, Homo sapiens
cagttttccccttgcttcccaggcccttgacatggcttacctgccttcactcccagcaccttgcccaacaggataagctggatccccttggccttctgaatatcccagtgtcttcaggtttcccaagtaccatcttcactgggctccctctttaataagaaggagaacaaagaagttattcttaaacttctggtcatatttgagaacataaatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaatatcatattgtatcatcaatgctgatatttaactgagttggtctttaggtttaagatggataaatgaatatcactacttgttctgaaaacatgtttgttgctttttatctcgctgcctagattgaaatattttgctatttcttctgcataagtgacagtgaaccaattcatcatgagtaagctcccttctgtcattttcattgatttaatttgtgtatcatcaataaaattgtatgttaatgctggaaagaaaaaaagaagaaagaaagaaaccatccctgtccttcagtttataatctagttggagagataagaaacgtacaaaccaaaagataacagaatatctgaagcatgtactcattgtcagatgttccctctgagagcacagaggaggcaaaagcttctgtgggatgtgctagtcggctaaagcttcacagaggaggtggcaattgaaaatgagtcctgaatggggtagggtggttagggaattccatgagacaagacaaggggggcatggtgtgagaaaggcatggaagtaggaaccctcttcctatgacaggagatcattctgcttagagtggagagtgtggagagtgggagtagataattttggaaagctgggtgaagccagttgtggagaattgtttgaatattatcccattgaatacccagagccactaaatctttttttactagaaaataattggggtccatatgaaagtctctattactgagtagtgtcaatgagggtgtggcaaaatggagcctttcacatcctagtggtggccatttggtaatacagatataagccttaaactatgtaaacccttgtcctaaggaagtaattgaataattgcccaaagattgtatgtatgaggctgttcatcccagcactgtctaagctagtaaaaattggaaacaatttaagtatctagcacattggattggttataaagcaaggaatgttcacacagtaggatattataagtatgctgatggaaatctatattgccaggaaaagctattcattatgcgttgtgaagtcagaaagtaaaaaagggtagatagaagtattcgaagtatagttccattttttgagactaataaaacatatgtttaaaaggacactaaaaactggagttatagatatccagatagaaacagtagttatctttgggtagaagaataatgagtgatctttacttttttactttttattcatctttgtgtttttatttatctaaaatgggtattgatttttaggacggttttgaaaaagaaaagtgttgggaatgaagcaagtgattgattggaaaacatactgaatggaagaaatatttagattaaaaatgaggtaggttgaagtttcttctctgaaatgatagataaatggtgaagataaggcttattgtgaggattcagtgaggtaatatatgcaaagtacttacaatgttctggcacatagtaattaattaagaaaatcgagcacccttaattacctagaatgcagggttgttagttttttggttgacttttgttttgctggggcattctgccatgttttagtgtcatttaataaataatagtaacaataaaggttaacatttattaagtgac

SEQ ID NO: 307218 - DNA, 2342 bp, Homo sapiens
gtagccctcacgtgaccaagagctgacgtgtgcagaagtccttcttgtcctggtcgttgttcccgtctgagtaccagctccccactgccctgagggcgggccggcctgcggcggagggaaaaaggaagaggagaaggaaattgtcccgaatccctgcaggtctttctgtaggttgcggcacaacgccaggcaaaagaagaggaaggaatttaatcctaatcggtggaggtcgatttgagggtctgctgtagcaggtggctccgcttgaagcgagggaggaagtttcctccgatcagtagagattggaaagattgttgggagtggcacaccactagggaaaagaagaaggggcgaactgcttgtcttgaggaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaagaaaccaaacttcaggttctgaaactccttttgaatttggctgaaaatccagccatgactagggaactgctcagggcccaagtaccatcttcactgggctccctctttaataagaaggagaacaaagaagttattcttaaacttctggtcatatttgagaacataaatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaatatcatattgtatcatcaatgctgatatttaactgagttggtctttaggtttaagatggataaatgaatatcactacttgttctgaaaacatgtttgttgctttttatctcgctgcctagattgaaatattttgctatttcttctgcataagtgacagtgaaccaattcatcatgagtaagctcccttctgtcattttcattgatttaatttgtgtatcatcaataaaattgtatgttaatgctggaaagaaaaaaagaagaaagaaagaaacgaagaaagaagaagggagggaggaagggagggaagggaaggagggaaataacactaacatcagcatacagctatgagagatgaagaccatagaatcaaaccaagccccagacaggggtgggcttaagaagcactttgaatcttctggctatctcactttatttccatagctgccttgcaagatgagaagtgcaagaatggtcatccttattttacagatgaggcccagagatcagagatgatcttgactgggtgtgtacctggtgaccagataaggactggggaaacatcgcgtacaggtcac

SEQ ID NO: 307219 - DNA, 1310 bp, Homo sapiens
acgtactgggatgctagccagtttgaaccagtaatatctgaagcatgtactcattgtcagatgttccctctgagagcacagaggaggcaaaagcttctgtgggatgtgctagtcggctaaagcttcacagaggaggtggcaattgaaaatgagtcctgaatggggtagggtggttagggaattccatgagacaagacaaggggggcatggtgtgagaaaggcatggaagtaggaaccctcttcctatgacaggagatcattctgcttagagtggagagtgtggagagtgggagtagataattttggaaagctgggtgaagccagttgtggagaattgtttgaatattatcccattgaatacccagagccactaaatctttttttactagaaaataattggggtccatatgaaagtctctattactgagtagtgtcaatgagggtgtggcaaaatggagcctttcacatcctagtggtggccatttggtaatacagatataagccttaaactatgtaaacccttgtcctaaggaagtaattgaataattgcccaaagattgtatgtatgaggctgttcatcccagcactgtctaagctagtaaaaattggaaacaatttaagtatctagcacattggattggttataaagcaaggaatgttcacacagtaggatattataagtatgctgatggaaatctatattgccaggaaaagctattcattatgcgttgtgaagtcagaaagtaaaaaagggtagatagaagtattcgaagtatagttccattttttgagactaataaaacatatgtttaaaaggacactaaaaactggagttatagatatccagatagaaacagtagttatctttgggtagaagaataatgagtgatctttacttttttactttttattcatctttgtgtttttatttatctaaaatgggtattgatttttaggacggttttgaaaaagaaaagtgttgggaatgaagcaagtgattgattggaaaacatactgaatggaagaaatatttagattaaaaatgaggtaggttgaagtttcttctctgaaatgatagataaatggtgaagataaggcttattgtgaggattcagtgaggtaatatatgcaaagtacttacaatgttctggcacatagtaattaattaagaaaatcgagcacccttaattacctagaatgcagggttgttagttttttggttgacttttgttttgctggggcattctgccatgttttagtgtcatttaataaataatagtaacaataaaggttaacatttattaagtgac

SEQ ID NO: 307220 - DNA, 1319 bp, Homo sapiens
ccgttcctgtcttcagttttgtacaaaccaaaagataacagaatatctgaagcatgtactcattgtcagatgttccctctgagagcacagaggaggcaaaagcttctgtgggatgtgctagtcggctaaagcttcacagaggaggtggcaattgaaaatgagtcctgaatggggtagggtggttagggaattccatgagacaagacaaggggggcatggtgtgagaaaggcatggaagtaggaaccctcttcctatgacaggagatcattctgcttagagtggagagtgtggagagtgggagtagataattttggaaagctgggtgaagccagttgtggagaattgtttgaatattatcccattgaatacccagagccactaaatctttttttactagaaaataattggggtccatatgaaagtctctattactgagtagtgtcaatgagggtgtggcaaaatggagcctttcacatcctagtggtggccatttggtaatacagatataagccttaaactatgtaaacccttgtcctaaggaagtaattgaataattgcccaaagattgtatgtatgaggctgttcatcccagcactgtctaagctagtaaaaattggaaacaatttaagtatctagcacattggattggttataaagcaaggaatgttcacacagtaggatattataagtatgctgatggaaatctatattgccaggaaaagctattcattatgcgttgtgaagtcagaaagtaaaaaagggtagatagaagtattcgaagtatagttccattttttgagactaataaaacatatgtttaaaaggacactaaaaactggagttatagatatccagatagaaacagtagttatctttgggtagaagaataatgagtgatctttacttttttactttttattcatctttgtgtttttatttatctaaaatgggtattgatttttaggacggttttgaaaaagaaaagtgttgggaatgaagcaagtgattgattggaaaacatactgaatggaagaaatatttagattaaaaatgaggtaggttgaagtttcttctctgaaatgatagataaatggtgaagataaggcttattgtgaggattcagtgaggtaatatatgcaaagtacttacaatgttctggcacatagtaattaattaagaaaatcgagcacccttaattacctagaatgcagggttgttagttttttggttgacttttgttttgctggggcattctgccatgttttagtgtcatttaataaataatagtaacaataaaggttaacatttattaagtgac

SEQ ID NO: 307221 - DNA, 1761 bp, Homo sapiens
gtagccctcacgtgaccaagagctgacgtgtgcagaagtccttcttgtcctggtcgttgttcccgtctgagtaccagctccccactgccctgagggcgggccggcctgcggcggagggaaaaaggaagaggagaaggaaattgtcccgaatccctgcaggtctttctgtaggttgcggcacaacgccaggcaaaagaagaggaaggaatttaatcctaatcggtggaggtcgatttgagggtctgctgtagcaggtggctccgcttgaagcgagggaggaagtttcctccgatcagtagagattggaaagattgttgggagtggcacaccactagggaaaagaagaaggggcgaactgcttgtcttgaggaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaagaaaccaaacttcaggttctgaaactccttttgaatttggctgaaaatccagccatgactagggaactgctcagggcccaagtaccatcttcactgggctccctctttaataagaaggagaacaaagaagttattcttaaacttctggtcatatttgagaacataaatgataatttcaaatgggaagaaatatttagattaaaaatgaggtaggttgaagtttcttctctgaaatgatagataaatggtgaagataaggcttattgtgaggattcagtgaggtaatatatgcaaagtacttacaatgttctggcacatagtaattaattaagaaaatcgagcacccttaattacctagaatgcagggttgttagttttttggttgacttttgttttgctggggcattctgccatgttttagtgtcatttaataaataatagtaacaataaaggttaacatttattaagtgac

SEQ ID NO: 307222 - DNA, 230 bp, Homo sapiens
tttgagacccgttggatcccccgggctgcttgaattcggcactacctgagggcgggccggcctgcggcggagggaaaaaggaagaggagaaggaaattgtcccgaatccctgcaggtcagtacctggaagattccataaagtcggggtgcttgagggcgtagggccgagaccgtcgcgggtactgaggcgcctccgtcgtctctcccactcgccgcccgctttccaagac

SEQ ID NO: 307223 - DNA, 871 bp, Homo sapiens
ctgagtaccagctccccactgccctgagggcgggccggcctgcggcggagggaaaaaggaagaggagaaggaaattgtcccgaatccctgcaggtcagtacctggaagattccataaagtcggggtgcttgagggcgtagggccgagaccgtcgcgggtactgaggcgcctccgtcgtctctcccactcgccgcccgctttccaagacatatgtcccgcttgcagcccatttcgatgctgcgaaacggtgagctgcggggtgtttggggaagagctcagagactgggaaatgggaatctgctgggagcctagggccgcaatccggaaagggagctgtggcctgggtgttggcccctagtccaccaggacagtgccggaggggaatggctggatatgggggcgggggtggtgagatgcaacgcgatatgtcagcagaaccccaagagaggtaataggggtgggaaacctctgacaaccaggcctccgaattagaaaagagttttgtgttctggggactagtccgtccaccaagcgctcagtggcggcagtttcccgtctttctgcctgtggctgtgtcttactgaccatggctctgtgtctagtgggtccaagcctctcccgggtggccagtctttctgtaggttgcggcacaacgccaggcaaaagaagaggaaggaatttaatcctaatcggtggaggtcgatttgagggtaagaccatctggggaccctaggagggacgggggtggcggcgggggtggggagaaggcagagaaggtaataatctaggtacatgtctgagtccgaatgtgtttcttgcactccccggactgtggcgaaatggcgtgctttgtgtgtctgtggttgggggg

SEQ ID NO: 307224 - DNA, 7629 bp, Homo sapiens
  misc_feature (3431)..(3431): n is a, c, g, or t
ggaccacactgcatcccaaaatgcccaggatctcataggcatccctcatctaggtgtttctggatcctcaacaaaatggcattccgagctgtccccaacagagggtccccattcagcaggttcatccacacctgggtttttgagccccatggcagaactgtcccatccgtctccccctcccccagcacttggaagtcttcttcagcttccagatggaagcccctcatggtcaatgttggaagtggcttcaggtcctgcatccacccagcagatcaaagctggggtgcctggaagagtgcacaatggggtgtctttgccaacttttaagaatacagaaacagcgacccatgaggctgagcctccacttttccagactgcagaatcaggggccatagaaatgaccagcagaaagctagcctctgccactgcaaatgactctgctaacccgctgcatttgtcagcagctccagagaattccagagggcccgccctttcggcagaacacacctcttctttggtgccttctctgcatatcaccacactgggtcaagagcaagccatcctttctggggcggttcccgcatcaccatcaactgggacagccgactttccctccatacttactttcctccagcccacagagaatcatgcctccccatctcctgtgccagaaatgcccactcttccagcagagggcagtgatgggtcccctcctgcaactagagacttgctcctctcaagcaaagttcctaatcttctttccacatcttggacatttccccggtggaaaaaggacagtgtgacagccattttagggaagaatgaagaggcaaatgtgacgattcctctccaggcctttccaaggaaagaggttttgagtcttcacactgtaaatggatttgtctctgatttcagcaccggtagtgtctcatctcccatcattacagcaccaaggacgaatccccttccttcaggaccacctctaccttccatactctccatacaagccacccagactgttttcccatctctcttggcttttccagcaccaagccagaggcttatgcagctgctgtggaccattctgggttgccagcttcagcttccaaacaggtgagagcatcgccctcctccatggatgtatatgattccttaacaataggagacatgaaaaagccagcaaccacagatgttttctggagttctctttcagcagaaactggatctctttccacagaatcaataatatctggcttgcagcagcaaacaaattatgatttaaatggacacacaattagcaccacaagttgggaaactcatttagctccaacagctcctcccaatggtttaacttcagctgccgatgccataaaatctcaggatttcaaagatactgctgggcattcagtgactgcagaagggtttagtattcaggatctagtcctcggtacaagcattgagcagcctgtgcaacagtcagacatgaccatggttggaagccatatagacctctggcccacaagcaataacaaccattccagagacttccaaacagctgaagttgcatattactcacccacaactcgacattccgtgtctcatcctcagctacagttgcccaaccagccagcacatcctcttttgctaacctcaccaggaccaacttctacaggtagcttgcaggaaatgctttcagatggaacagatacaggttctgaaatttccagtgacatcaattcatcacctgagagaaatgcttccacaccattccagaacatcttgggatatcactctgctgctgaatcttctatatcgaccagtgtctttcccaggacctcctccagagtgctgcgggcttctcagcaccccaagaaatggacagcggacacagtatcatctaaggtacagccaacagcagcagctgccgtcacattgtttctgaggaaatcaagtccacctgcactgtctgcagccctggttgctaagggcaccagcagcagccctttggccgtggcctcaggaccagctaagagcagttcgatgactactcttgctaaaaatgtcacaaacaaggccgcatctggcccaaagaggacaccaggggcagtccatacagccttcccattcacaccaacctacatgtatgcaagaacaggacataccacgagcacacatacagccatgcaaggaaacatggacactgcctctggcctgttgtctacaacttacctccccaggaaaccacaagccatgcacaccggcctcccaaaccccaccaacctggagatgcccagagcatccacgccacgcccactgacagtcacggccgcgctgacatccattacagcctcagtgaaggccacccggttgccaccattgcgagcagaaaacacagatgctgtccttcctgctgcatcggctgcagtggtcacgactggcaaaatggcatccaacctggagtgtcagatgtccagtaagctcctggtgaagacagttctctttctcacccaaaggagagtgcagatcagtgaatccttgaagttcagtatcgccaaagggctcacacaggcattgcggaaggctttccaccagaacgatgtctcagctcacgtggacattctggaatattctcataatgtcacagttggttattatgctaccaaagggaagttggtgtatttgcctgctgtggtgatcgaaatgctgggtgtgtatggagtcagcaacgtcactgcagacctgaagcaacacaccccacacttacagtctgtggcagtacttgcctccccatggaatccccagcctgcaggctacttccagctaaaaacagtgctgcagtttgtgagccaagcggacaacatacagtcctgcaagtttgctcagacaatggaacagaggctgcagaaggcattccaggatgccgagaggaaagtcctgaataccaaaagcaacttgacaattcagattgtgagcacgtccaatgcctcccaggcagtcaccttggtgtacgtcgtgggcaatcagagcacattcctcaacggcaccgtcgccagcagcctcctcagccagctctcggctgagctggtgggattctacctcacctatccgccgctaaccattgctgaaccactggaatatcccaaccttgacatatcagaaacaaccagagactattgggtaattacagtgctgcagggtgtggacaattcgctggtgggcctgcacaaccagagctttgcccgggtcatggagcagcgcctggcccagctattcatgatgtcccagcaacaaggccggcggtttaaacgggccaccaccctgggaagctacactgtgcagatggtgaagatgcagcgtgtcccaggcccgaaggacccagcggagctgacttactataccctgtacaacgggaagcctttgttggggaccgnagctgccaagatcctgagcaccattgattcccaaaggatggccttgacccttcatcacgttgtccttctgcaagctgaccccgtggtgaagaacccgcccaataacctgtggatcatcgctgcagtgctggcgcccattgccgtggtcacggtcatcatcatcatcatcactgccgtgctctgcaggaagaacaagaacgacttcaagcctgacaccatgataaacctgccgcagagagcaaagcctgtgcaaggctttgattatgccaagcaacacctgggccagcaaggggcagatgaggaggtcatccctgtgactcaggagacagtggttctcccactgcccattagagatgctcctcaggaaagagacgtcgctcaggatggaagcaccatcaagaccgccaaatccactgaaaccaggaagagcaggtcgcccagtgagaatggctctgtcatcagcaacgaatcagggaagcccagctcagggagacgctcaccccagaatgtaatggcacagcagaaagtgacaaaggaggaggcaaggaagagaaatgtgccagcgagtgacgaagaggagggagcggttctatttgacaactccagcaaggtggccgctgaaccctttgacacatcttctgggtctgtgcagctcattgccataaaacccacagccctccccatggtgccccccacctcggacaggagccaggagtcatcggcagtcctcaacggcgaggtgaacaaagccctgaagcagaagtcagacatcgagcactatcggaacaagctgcgcctcaaagccaagaggaagggatattacgacttccctgcagtggagacgagcaagggtctgaccgaaagaaagaagatgtatgaaaaagccccgaaggaaatggagcatgttttggatccagattcagaactctgtgctccattcaccgagtctaaaaacaggcaacagatgaagaactctgtctacagaagccggcagtctctgaacagcccgagtccaggggaaaccgagatggaccttctggtgactcgggagcgaccccggcgtggaatccgcaacagcggatacgatactgagcctgaaatcatagaggaaaccaacattgacagagttcctgagccccggggctattccaggtctcgacaggtgaaaggccactcggagacctccacactgagctcccagccatccatcgacgaggtcaggcagcagatgcacatgctgctggaggaggccttcagcctggcatccgcgggccacgcaggccagagccggcaccaagaggcctacggctcagcccagcacctgccctattcggaggtggtgaccagcgctccggggaccatgacgcggcccagggccggggtgcagtgggtgccgacctaccgcccagaaatgtatcagtacagtctgccccggccggcttacaggttttcccagcttcctgagatggtcatgggctcaccgcctccacccgtacctccccggactggtcctgtggctgtcgcttctctcaggcgatccacctcagacatcggcagcaagaccagaatggccgagtctacagggcccgagccggcccagctgcacgacagcgcctccttcacgcagatgtccagaggccctgtgtccgtgacgcagttggatcagtcggctttaaattactcaggtaatacggtgccagcagtgttcgccatcccagctgccaacagacctggcttcaccggctacttcatcccaacgcctccctcatcctataggaaccaggcctggatgtcctatgcaggagagaatgagctcccgagccagtgggcagattcggtgcccctcccagggtacatcgaggcctacccccgatcacggtacccccagagctctccctccaggcttcctcgtcagtacagccagccagccaacctgcaccccagcctggagcaggccccggcgccctccacagcggcctcgcagcagagcctggcagaaaacgacccgtctgacgctcccctgaccaacatctccactgcggcccttgtgaaggccatccgggaggaggtggccaagctggccaaaaaacagacagacatgtttgagttccaggtctaacgccttagccccgtgggactctggacttccaaactctgaggactcagcctttgggtttcccatgcctacgtgttaggacttgagacatagcaatgggtgagtctttctcaccctccatttctgaaaaggtgaactatggggcttctgggaacaggaaactcttgaacgactagattcttggctcatccaactgattgtgggtcaagtccctggcttggggccttatgtttgatactctctcatgtcaaatgtttgaactttgggcatgtgccctatggaagcttagtcacaagaggcactagctaatctacagattcctatccaatgccacattttaataaatcaccggaagcgggagaatgtagctcttatcttcggtgacctctgcatgttaactctgtttctgtgttaaaggcaatgcaggagtgtggattaagcaccagactgtattctcattcaaccatgaccgtgcgcattaaaatcagtttgtaagggagacactgactccagccaagaaacctgagccccttttttttaggttcatattcaaagtcaaatgaactggatgaaagtcagtaccaatggctgtgcctattaaatagacctgattctttgtttccctcgtcaattaaacaaaggccaagaaagagagaagatgagagggaatggtgggatttgcgttgacagattttttaaaaggtgttgccattttggaaataaaagtcccctacaagttaggatctaactgaaagagaatcggtgctaagagcttttaggatcctacaaaagaaacacagttatttgtgaaggtttttctttgccttgttttgaaggtggcctgagaatggagcttctctttttcttgggataatagatacatcaacttttacaagaaaatctctgtctcttcaacaatgatgtccagtgtgtgctgctgagtggtacaaaaggaaatagtacttgattcctgttagaaacaggagtggtagaaccacagtcttcccaggccgcagcctctgtttatagaagcttctgaatgtagaaaagctgttgaatttcatttaaatgtaaataaccttttaaaaagcgtatggagttagccagttccccctagttaatggacataggaagacatttgctgaaatggtagggtggccactttgtgaccatgatgttgcaagttgccctccctggcatggtgagttggcttccagagctgtgggtagaggacatcgcctcacggcactgaggcaccagccgctgcctacccatcaatgcaagcaaaacagctactgactttgtgtagcagggagattggggactctggttccctcgccaagtgtggcagcctgtgcagtgttgggggcttacttggtatctgttggagaatgaggtcctgtcctgctttcacccatgacccatctagcttcagctgtatccattttcttctgagcccatcttccattgtcctcaacgagtttctttggtctttactgaaagaagatagtagaaatttaaaagttgagagaagactagaaatggaactgattagaaggggaggttcaaactgtcaatgcacagacttttcaaagaagttgtttatattttccaatggcaaactgccctttctggaatgttcagagatgatgtgtcatggaaccttcaaacaagtctcttgttcggatgataataggtagtgtccttttagtatgctggttgatctttcatagtgttagtgttttgttacttaaaaaggaaatcagctataaataaaatgtatttttgtaattcccgtgtgtatatatggtatatttctatcaatggccagttgttgtagtccaaaacctaaatcagtttgcaaaacactgtggacagtgcgagattttattgacaggttaacacaatgcctacgtctatccacataggcattcaatgcacttgaatgaacaaagagccaaagaaactcagcctgttcatgcaaatggtatgagtctgataaaatcagctacattgtcctgctttatccaataattaatatttcattagtgcaatgatatcaaccagtactttgtctacttg

SEQ ID NO: 307225 - DNA, 7647 bp, Homo sapiens
  misc_feature (3449)..(3449): n is a, c, g, or t
ggaccacactgcatcccaaaatgcccaggatctcataggcatccctcatctaggtgtttctggatcctcaacaaaatggcattccgagctgtccccaacagagggtccccattcagcaggttcatccacacctgggtttttgagccccatggcagaactgtcccatccgtctccccctcccccagcacttggaagtcttcttcagcttccagatggaagcccctcatggtcaatgttggaagtggcttcaggtcctgcatccacccagcagatcaaagctggggtgcctggaagagtgcacaatggggtgtctttgccaacttttaagaatacagaaacagcgacccatgaggctgagcctccacttttccagactgcagaatcaggggccatagaaatgaccagcagaaagctagcctctgccactgcaaatgactctgctaacccgctgcatttgtcagcagctccagagaattccagagggcccgccctttcggcagaacacacctcttctttggtgccttctctgcatatcaccacactgggtcaagagcaagccatcctttctggggcggttcccgcatcaccatcaactgggacagccgactttccctccatacttactttcctccagcccacagagaatcatgcctccccatctcctgtgccagaaatgcccactcttccagcagagggcagtgatgggtcccctcctgcaactagagacttgctcctctcaagcaaagttcctaatcttctttccacatcttggacatttccccggtggaaaaaggacagtgtgacagccattttagggaagaatgaagaggcaaatgtgacgattcctctccaggcctttccaaggaaagaggttttgagtcttcacactgtaaatggatttgtctctgatttcagcaccggtagtgtctcatctcccatcattacagcaccaaggacgaatccccttccttcaggaccacctctaccttccatactctccatacaagccacccagactgttttcccatctctcttggcttttccagcaccaagccagaggcttatgcagctgctgtggaccattctgggttgccagcttcagcttccaaacaggtgagagcatcgccctcctccatggatgtatatgattccttaacaataggagacatgaaaaagccagcaaccacagatgttttctggagttctctttcagcagaaactggatctctttccacagaatcaataatatctggcttgcagcagcaaacaaattatgatttaaatggacacacaattagcaccacaagttgggaaactcatttagctccaacagctcctcccaatggtttaacttcagctgccgatgccataaaatctcaggatttcaaagatactgctgggcattcagtgactgcagaagggtttagtattcaggatctagtcctcggtacaagcattgagcagcctgtgcaacagtcagacatgaccatggttggaagccatatagacctctggcccacaagcaataacaaccattccagagacttccaaacagctgaagttgcatattactcacccacaactcgacattccgtgtctcatcctcagctacagttgcccaaccagccagcacatcctcttttgctaacctcaccaggaccaacttctacaggtagcttgcaggaaatgctttcagatggaacagatacaggttctgaaatttccagtgacatcaattcatcacctgagagaaatgcttccacaccattccagaacatcttgggatatcactctgctgctgaatcttctatatcgaccagtgtctttcccaggacctcctccagagtgctgcgggcttctcagcaccccaagaaatggacaggtgcagccactaatgcagcggacacagtatcatctaaggtacagccaacagcagcagctgccgtcacattgtttctgaggaaatcaagtccacctgcactgtctgcagccctggttgctaagggcaccagcagcagccctttggccgtggcctcaggaccagctaagagcagttcgatgactactcttgctaaaaatgtcacaaacaaggccgcatctggcccaaagaggacaccaggggcagtccatacagccttcccattcacaccaacctacatgtatgcaagaacaggacataccacgagcacacatacagccatgcaaggaaacatggacactgcctctggcctgttgtctacaacttacctccccaggaaaccacaagccatgcacaccggcctcccaaaccccaccaacctggagatgcccagagcatccacgccacgcccactgacagtcacggccgcgctgacatccattacagcctcagtgaaggccacccggttgccaccattgcgagcagaaaacacagatgctgtccttcctgctgcatcggctgcagtggtcacgactggcaaaatggcatccaacctggagtgtcagatgtccagtaagctcctggtgaagacagttctctttctcacccaaaggagagtgcagatcagtgaatccttgaagttcagtatcgccaaagggctcacacaggcattgcggaaggctttccaccagaacgatgtctcagctcacgtggacattctggaatattctcataatgtcacagttggttattatgctaccaaagggaagttggtgtatttgcctgctgtggtgatcgaaatgctgggtgtgtatggagtcagcaacgtcactgcagacctgaagcaacacaccccacacttacagtctgtggcagtacttgcctccccatggaatccccagcctgcaggctacttccagctaaaaacagtgctgcagtttgtgagccaagcggacaacatacagtcctgcaagtttgctcagacaatggaacagaggctgcagaaggcattccaggatgccgagaggaaagtcctgaataccaaaagcaacttgacaattcagattgtgagcacgtccaatgcctcccaggcagtcaccttggtgtacgtcgtgggcaatcagagcacattcctcaacggcaccgtcgccagcagcctcctcagccagctctcggctgagctggtgggattctacctcacctatccgccgctaaccattgctgaaccactggaatatcccaaccttgacatatcagaaacaaccagagactattgggtaattacagtgctgcagggtgtggacaattcgctggtgggcctgcacaaccagagctttgcccgggtcatggagcagcgcctggcccagctattcatgatgtcccagcaacaaggccggcggtttaaacgggccaccaccctgggaagctacactgtgcagatggtgaagatgcagcgtgtcccaggcccgaaggacccagcggagctgacttactataccctgtacaacgggaagcctttgttggggaccgnagctgccaagatcctgagcaccattgattcccaaaggatggccttgacccttcatcacgttgtccttctgcaagctgaccccgtggtgaagaacccgcccaataacctgtggatcatcgctgcagtgctggcgcccattgccgtggtcacggtcatcatcatcatcatcactgccgtgctctgcaggaagaacaagaacgacttcaagcctgacaccatgataaacctgccgcagagagcaaagcctgtgcaaggctttgattatgccaagcaacacctgggccagcaaggggcagatgaggaggtcatccctgtgactcaggagacagtggttctcccactgcccattagagatgctcctcaggaaagagacgtcgctcaggatggaagcaccatcaagaccgccaaatccactgaaaccaggaagagcaggtcgcccagtgagaatggctctgtcatcagcaacgaatcagggaagcccagctcagggagacgctcaccccagaatgtaatggcacagcagaaagtgacaaaggaggaggcaaggaagagaaatgtgccagcgagtgacgaagaggagggagcggttctatttgacaactccagcaaggtggccgctgaaccctttgacacatcttctgggtctgtgcagctcattgccataaaacccacagccctccccatggtgccccccacctcggacaggagccaggagtcatcggcagtcctcaacggcgaggtgaacaaagccctgaagcagaagtcagacatcgagcactatcggaacaagctgcgcctcaaagccaagaggaagggatattacgacttccctgcagtggagacgagcaagggtctgaccgaaagaaagaagatgtatgaaaaagccccgaaggaaatggagcatgttttggatccagattcagaactctgtgctccattcaccgagtctaaaaacaggcaacagatgaagaactctgtctacagaagccggcagtctctgaacagcccgagtccaggggaaaccgagatggaccttctggtgactcgggagcgaccccggcgtggaatccgcaacagcggatacgatactgagcctgaaatcatagaggaaaccaacattgacagagttcctgagccccggggctattccaggtctcgacaggtgaaaggccactcggagacctccacactgagctcccagccatccatcgacgaggtcaggcagcagatgcacatgctgctggaggaggccttcagcctggcatccgcgggccacgcaggccagagccggcaccaagaggcctacggctcagcccagcacctgccctattcggaggtggtgaccagcgctccggggaccatgacgcggcccagggccggggtgcagtgggtgccgacctaccgcccagaaatgtatcagtacagtctgccccggccggcttacaggttttcccagcttcctgagatggtcatgggctcaccgcctccacccgtacctccccggactggtcctgtggctgtcgcttctctcaggcgatccacctcagacatcggcagcaagaccagaatggccgagtctacagggcccgagccggcccagctgcacgacagcgcctccttcacgcagatgtccagaggccctgtgtccgtgacgcagttggatcagtcggctttaaattactcaggtaatacggtgccagcagtgttcgccatcccagctgccaacagacctggcttcaccggctacttcatcccaacgcctccctcatcctataggaaccaggcctggatgtcctatgcaggagagaatgagctcccgagccagtgggcagattcggtgcccctcccagggtacatcgaggcctacccccgatcacggtacccccagagctctccctccaggcttcctcgtcagtacagccagccagccaacctgcaccccagcctggagcaggccccggcgccctccacagcggcctcgcagcagagcctggcagaaaacgacccgtctgacgctcccctgaccaacatctccactgcggcccttgtgaaggccatccgggaggaggtggccaagctggccaaaaaacagacagacatgtttgagttccaggtctaacgccttagccccgtgggactctggacttccaaactctgaggactcagcctttgggtttcccatgcctacgtgttaggacttgagacatagcaatgggtgagtctttctcaccctccatttctgaaaaggtgaactatggggcttctgggaacaggaaactcttgaacgactagattcttggctcatccaactgattgtgggtcaagtccctggcttggggccttatgtttgatactctctcatgtcaaatgtttgaactttgggcatgtgccctatggaagcttagtcacaagaggcactagctaatctacagattcctatccaatgccacattttaataaatcaccggaagcgggagaatgtagctcttatcttcggtgacctctgcatgttaactctgtttctgtgttaaaggcaatgcaggagtgtggattaagcaccagactgtattctcattcaaccatgaccgtgcgcattaaaatcagtttgtaagggagacactgactccagccaagaaacctgagccccttttttttaggttcatattcaaagtcaaatgaactggatgaaagtcagtaccaatggctgtgcctattaaatagacctgattctttgtttccctcgtcaattaaacaaaggccaagaaagagagaagatgagagggaatggtgggatttgcgttgacagattttttaaaaggtgttgccattttggaaataaaagtcccctacaagttaggatctaactgaaagagaatcggtgctaagagcttttaggatcctacaaaagaaacacagttatttgtgaaggtttttctttgccttgttttgaaggtggcctgagaatggagcttctctttttcttgggataatagatacatcaacttttacaagaaaatctctgtctcttcaacaatgatgtccagtgtgtgctgctgagtggtacaaaaggaaatagtacttgattcctgttagaaacaggagtggtagaaccacagtcttcccaggccgcagcctctgtttatagaagcttctgaatgtagaaaagctgttgaatttcatttaaatgtaaataaccttttaaaaagcgtatggagttagccagttccccctagttaatggacataggaagacatttgctgaaatggtagggtggccactttgtgaccatgatgttgcaagttgccctccctggcatggtgagttggcttccagagctgtgggtagaggacatcgcctcacggcactgaggcaccagccgctgcctacccatcaatgcaagcaaaacagctactgactttgtgtagcagggagattggggactctggttccctcgccaagtgtggcagcctgtgcagtgttgggggcttacttggtatctgttggagaatgaggtcctgtcctgctttcacccatgacccatctagcttcagctgtatccattttcttctgagcccatcttccattgtcctcaacgagtttctttggtctttactgaaagaagatagtagaaatttaaaagttgagagaagactagaaatggaactgattagaaggggaggttcaaactgtcaatgcacagacttttcaaagaagttgtttatattttccaatggcaaactgccctttctggaatgttcagagatgatgtgtcatggaaccttcaaacaagtctcttgttcggatgataataggtagtgtccttttagtatgctggttgatctttcatagtgttagtgttttgttacttaaaaaggaaatcagctataaataaaatgtatttttgtaattcccgtgtgtatatatggtatatttctatcaatggccagttgttgtagtccaaaacctaaatcagtttgcaaaacactgtggacagtgcgagattttattgacaggttaacacaatgcctacgtctatccacataggcattcaatgcacttgaatgaacaaagagccaaagaaactcagcctgttcatgcaaatggtatgagtctgataaaatcagctacattgtcctgctttatccaataattaatatttcattagtgcaatgatatcaaccagtactttgtctacttg

SEQ ID NO: 307226 - DNA, 780 bp, Homo sapiens
gatgcctgagataaatgggtagccagatgcacctgtactctgctcacacacccaggcccctgcccagtcccactacatcccaaatcccttttgttttcttgctctgatagagacatcaactttgtgatttctcagactaggaccagagaatagctccaggaagttggcatttcatccgaattcgggacatgaggctatagcccttcttctccagcttcctgtatctcctgcacttcatggcccgaggcaccttgcattcttatattttccatccttgcctgccctttagaattgtcctaggtcctaggagtagctggtaaaggcacatagctgtccctcatgtcctgagctctcagaggacttggtatggaatgctgcctatgcctgtgaactttgtaattagaaacaggttcaagttttggggttttctttttgccagatactagctgtgtgattttgagcaagttaacctccctgtgcctcagtttcttctgctgtaaaatgggggtgacaatggtccctataccttaggacagtgagctgtgcacatgaagcccttaacacagtggctggaatgtgataagggatattaacttgtagataccttgtggagtgaaacattgaggtgattttgtagacaacaagaggagaaggaaggtattttaaaatccaggcgctaccctcatgccgactaaggtgtgagaggctcacagctcacatgagagggtgatcttgcctgaagcacatgatttttaagtggctggaacctgggaaaccgaa

SEQ ID NO: 307227 - DNA, 3828 bp, Homo sapiens
gcggccgctctccgggggggaggctgagagcaggcccgcctcgcccccccgcgggcccgccgcccctccctccctgtcctcagcccggcagcggcggcggcggcggcagtggcagtcgccggagaagcatcatgccgaggaggaagcagcaggcgccccggcgcgcagcagcctatgtttccgaagagttaaaggctgctgccctggtggacgaaggtttagacccagaggagcatacggcagatggagagccctcggccaagtacatgtgcccggagaaggagctcgccagggcctgccccagctaccagaactccccggccgccgagttttcctgccatgaaatggacagcgagtcacacatcagtgagaccagtgaccgaatggctgactttgaaagcggctccatcaagaacgaagaggagaccaaggaggtcacggtcccactggaagacacgactgtgtcggatagcctggagcagatgaaggccgtgtacaacaacttcctctccaactcctactggtccaacctcaacctcaacctgcaccagccctcctcggagaagaacaacggcagcagcagcagcagcagtagcagcagcagcagctgtggcagcgggagcttcgactggcaccagagcgccatggctaagacgctgcagcaggtgtcacagagccgcatgctcccggagcccagcctcttcagcaccgtgcagctgtaccggcagagcagcaagctctatggctccatcttcacgggggccagcaagttccgctgtaaggactgcagcgctgcctacgacaccctggtggagttgacggtgcacatgaacgagacggggcattaccgcgacgacaaccatgagaccgataacaacaaccccaagcgctggtccaagcctcgcaaacgctccttgctggaaatggaagggaaggaagacgcccagaaggtgctgaagtgcatgtactgtggccactcctttgagtccctgcaggatttgagtgtccatatgatcaaaacaaaacactaccaaaaagtgcctctgaaggaacccgtcactcctgtcgccgccaaaatcatccctgccactcggaagaaagcttccctggagctggagctccccagctccccagattccacaggtggaacccccaaagccaccatctcagacaccaacgatgcacttcagaagaactccaacccttacatcacgccaaataatcggtacggccaccagaatggggccagctatgcatggcactttgaggcccggaagtcgcagatcctgaagtgcatggagtgtgggagctcgcatgacaccctgcaggagctcactgcccacatgatggtcactggccacttcatcaaggtcaccaactctgctatgaaaaaggggaagcccattgtggagacgcctgtcacacctaccatcacaaccctgctggatgagaaggtccagtccgtgcccctggcagccaccaccttcacgtccccctccaatacacctgccagcatctccccaaaactgaatgtggaggtcaagaaggaagtcgacaaggagaaagcggtcactgacgagaaacctaagcaaaaagacaagcctggcgaagaagaggagaagtgtgacatctcttccaaataccattacttgactgaaaatgacttagaagagagtcccaagggggggcttgatatcctcaaatccttggaaaacacagtgacatccgcaatcaacaaggcccagaacggcactcctagctgggggggctatcccagcatccatgccgcctaccaacttcccaacatgatgaagttgtccctgggctcgtcggggaagagcacgcccctgaaacccatgtttggcaacagtgagattgtctccccgacgaaaaaccagaccctggtctctccacccagcagccagacgtcccccatgcccaagacaaactttcatgccatggaggagctggtgaaaaaggtcactgagaaagttgccaaagtggaggagaagatgaaggagccggatgggaagctttccccgcccaagcgggccactccctccccatgtagcagcgaagtcggggaacccatcaagatggaggcatccagcgatgggggcttccgcagccaggagaacagccccagccccccgcgggatgggtgcaaggatgggagccccctcgctgagccggtggagaatggcaaggagctggtgaagcccctagccagcagtttgagtggcagcacggccatcatcaccgaccacccgcctgaacagccttttgttaaccctttgagcgccctgcagtcagtcatgaacattcacctgggcaaggccgccaagccctccctgcctgccctggaccccatgagcatgcttttcaagatgagcaacagcctggcggagaaggctgctgtggccaccccgccgcccctgcagtccaagaaggcagaccacctcgaccgctatttctaccacgtcaacaacgaccagcccatagacttgacaaaagggaagagtgacaaaggctgctccttgggttcagtgcttctgtcacccacgtccacagccccggcaacctcctcatccacggtgacaacggcaaagacatctgccgtcgtatcattcatgtcaaactcgccgctacgcgagaatgccttgtcagatatatccgatatgctgaagaacttgacagagagccacacgtcaaaatcctccactccttccagcatctccgagaagtctgacattgacggggccactctggaggaggctgaggagtcgacgcccgcccagaagaggaagggccgccagtcaaactggaacccccagcacctcctgatcctccaggcccagtttgccgccagcctccggcagacctcagaagggaagtacatcatgtcagacctgagcccccaggagcggatgcatatctccaggttcaccgggctgtccatgaccaccatcagccactggctggccaacgtgaaataccagcttcgaaggacaggtggaacaaagttcctcaaaaacttggacactggccaccccgtcttcttttgtaacgattgtgcgtcccaaatcaggactccttccacgtacatcagtcacctagagtcacacttaggcttccggctacgggacttatccaaactgtccaccgaacagattaacagtcagatagcacaaaccaagtcaccgtcagaaaaaatggtgacgtcctcccccgaggaagacctggggacttcctatcagtgcaaactttgcaatcggacctttgccagcaagcacgctgttaaacttcaccttagcaaaacacacgggaaatctccggaagaccaccttctgtatgtctctgagttagagaagcagtagcatttgcttttgatagaaaggactgcagtttgctttgagggaaactgtggaaggcaccttcaggccccctctgacttgttgttcttggcacatgttcttattttaactgcagagaatcactctgggctggactgttttgtataactgtacagtgtttaatagaggtgcataatcagctgttgttactggtaaaatatgaaggttaaaatgcagtggtaagtgtttggaactttgtgtaaacgggatttagttgtgagcatcctcccgatgcttcaagctgcatgcattaacagacagtttaattaagcatttataacggaatcaggcacaccttttccacgagactcgagtgtgctggcatttctcaccctttcatctttagccctctgagtactttgaagcacttttgcattaatttggttaaaaaataaaataaaataataataatgta

SEQ ID NO: 307228 - DNA, 546 bp, Homo sapiens
gcggccgctctccgggggggaggctgagagcaggcccgcctcgcccccccgcgggcccgccgcccctccctccctgtcctcagcccggcagcggcggcggcggcggcagtggcagtcgccggagaagcatcatgccgaggaggaagcagcaggcgccccggcgcgcagcagacaagagcatcaattgggtggaggttctcagcacgtggtgggtggagaacgtgctgccctagtctcttcacactacccctgtgtacctgtggagcctaaaacacctgggaaggaagcaaaccccagagctccgaaacctccatttccaaaaaggatcgagagccagtctcctagaaatggagcccttagtggtggtccacgctggagacgatgacaaacaattggacccttgtgtccccaagctgtgggctccctggcgatgacaccggagctgtctctattttgcctgtcgggggaatgttccagcgcattttcccttattatgacttgattaaggacacaataaacccttgccatgatttttatctatttgca

SEQ ID NO: 307229 - DNA, 4979 bp, Homo sapiens
gcggccgctctccgggggggaggctgagagcaggcccgcctcgcccccccgcgggcccgccgcccctccctccctgtcctcagcccggcagcggcggcggcggcggcagtggcagtcgccggagaagcatcatgccgaggaggaagcagcaggcgccccggcgcgcagcagcctatgtttccgaagagttaaaggctgctgccctggtggacgaaggtttagacccagaggagcatacggcagatggagagccctcggccaagtacatgtgcccggagaaggagctcgccagggcctgccccagctaccagaactccccggccgccgagttttcctgccatgaaatggacagcgagtcacacatcagtgagaccagtgaccgaatggctgactttgaaagcggctccatcaagaacgaagaggagaccaaggaggtcacggtcccactggaagacacgactgtgtcggatagcctggagcagatgaaggccgtgtacaacaacttcctctccaactcctactggtccaacctcaacctcaacctgcaccagccctcctcggagaagaacaacggcagcagcagcagcagcagtagcagcagcagcagctgtggcagcgggagcttcgactggcaccagagcgccatggctaagacgctgcagcaggtgtcacagagccgcatgctcccggagcccagcctcttcagcaccgtgcagctgtaccggcagagcagcaagctctatggctccatcttcacgggggccagcaagttccgctgtaaggactgcagcgctgcctacgacaccctggtggagttgacggtgcacatgaacgagacggggcattaccgcgacgacaaccatgagaccgataacaacaaccccaagcgctggtccaagcctcgcaaacgctccttgctggaaatggaagggaaggaagacgcccagaaggtgctgaagtgcatgtactgtggccactcctttgagtccctgcaggatttgagtgtccatatgatcaaaacaaaacactaccaaaaagtgcctctgaaggaacccgtcactcctgtcgccgccaaaatcatccctgccactcggaagaaagcttccctggagctggagctccccagctccccagattccacaggtggaacccccaaagccaccatctcagacaccaacgatgcacttcagaagaactccaacccttacatcacgccaaataatcggtacggccaccagaatggggccagctatgcatggcactttgaggcccggaagtcgcagatcctgaagtgcatggagtgtgggagctcgcatgacaccctgcaggagctcactgcccacatgatggtcactggccacttcatcaaggtcaccaactctgctatgaaaaaggggaagcccattgtggagacgcctgtcacacctaccatcacaaccctgctggatgagaaggtccagtccgtgcccctggcagccaccaccttcacgtccccctccaatacacctgccagcatctccccaaaactgaatgtggaggtcaagaaggaagtcgacaaggagaaagcggtcactgacgagaaacctaagcaaaaagacaagcctggcgaagaagaggagaagtgtgacatctcttccaaataccattacttgactgaaaatgacttagaagagagtcccaagggggggcttgatatcctcaaatccttggaaaacacagtgacatccgcaatcaacaaggcccagaacggcactcctagctgggggggctatcccagcatccatgccgcctaccaacttcccaacatgatgaagttgtccctgggctcgtcggggaagagcacgcccctgaaacccatgtttggcaacagtgagattgtctccccgacgaaaaaccagaccctggtctctccacccagcagccagacgtcccccatgcccaagacaaactttcatgccatggaggagctggtgaaaaaggtcactgagaaagttgccaaagtggaggagaagatgaaggagccggatgggaagctttccccgcccaagcgggccactccctccccatgtagcagcgaagtcggggaacccatcaagatggaggcatccagcgatgggggcttccgcagccaggagaacagccccagccccccgcgggatgggtgcaaggatgggagccccctcgctgagccggtggagaatggcaaggagctggtgaagcccctagccagcagtttgagtggcagcacggccatcatcaccgaccacccgcctgaacagccttttgttaaccctttgagcgccctgcagtcagtcatgaacattcacctgggcaaggccgccaagccctccctgcctgccctggaccccatgagcatgcttttcaagatgagcaacagcctggcggagaaggctgctgtggccaccccgccgcccctgcagtccaagaaggcagaccacctcgaccgctatttctaccacgtcaacaacgaccagcccatagacttgacaaaagggaagagtgacaaaggctgctccttgggttcagtgcttctgtcacccacgtccacagccccggcaacctcctcatccacggtgacaacggcaaagacatctgccgtcgtatcattcatgtcaaactcgccgctacgcgagaatgccttgtcagatatatccgatatgctgaagaacttgacagagagccacacgtcaaaatcctccactccttccagcatctccgagaagtctgacattgacggggccactctggaggaggctgaggagtcgacgcccgcccagaagaggaagggccgccagtcaaactggaacccccagcacctcctgatcctccaggcccagtttgccgccagcctccggcagacctcagaagggaagtacatcatgtcagacctgagcccccaggagcggatgcatatctccaggttcaccgggctgtccatgaccaccatcagccactggctggccaacgtgaaataccagcttcgaaggacaggtggaacaaagttcctcaaaaacttggacactggccaccccgtcttcttttgtaacgattgtgcgtcccaaatcaggactccttccacgtacatcagtcacctagagtcacacttaggcttccggctacgggacttatccaaactgtccaccgaacagattaacagtcagatagcacaaaccaagtcaccgtcagaaaaaatggtgacgtcctcccccgaggaagacctggggacttcctatcagtgcaaactttgcaatcggacctttgccagcaagcacgctgttaaacttcaccttagcaaaacacacgggaaatctccggaagaccaccttctgtatgtctctgagttagagaagcagtagcatttgcttttgatagaaaggactgcagtttgctttgagggaaactgtggaaggcaccttcaggccccctctgacttgttgttcttggcacatgttcttattttaactgcagagaatcactctgggctggactgttttgtataactgtacagtgtttaatagaggtgcataatcagctgttgttactggtaaaatatgaaggttaaaatgcagtggtaagtgtttggaactttgtgtaaacgggatttagttgtgagcatcctcccgatgcttcaagctgcatgcattaacagacagtttaattaagcatttataacggaatcaggcacaccttttccacgagactcgagtgtgctggcatttctcaccctttcatctttagccctctgagtactttgaagcacttttgcattaatttggttaaaaaataaaataaaataataataatgtatgaagctctgttttttaaactccttaccagcttagttataatgaataatatgaacctccatttatgcaggtctgcaggggtataacacgccttgaaatttaaaagaatattattttcacattgaaacatagatgtatatattgtatagatttcagactctcttatgaaaaaaaatgtgattgtggttaaatgacctttttcttgcatttatagcaacagtgttttatgcacctgctatgctctgggcataagctgtgcctatgtatagtgtatatttctttttttcttttttttaaggtctatgggttttgttttttacatgcaaacattgtaaattatacagaagataccacagatagcatttataaagtatacagaaacattatctgaaagcaaagtatgatagtttgttttgctatacagtacatctatattgatagaggttcatgtttaaattatacatatttattagcatcatattgtcatttgttttgagcagtctgaataaacgagaccgggaaagacatccctggcaggcatcagaactattttgcacatgatttttaaaggtatttattagaaatcaaagaacactcaaaataaactcagtgctcaaagggttaagtctatttgaaaaggttaaaaaaaagaacaaaaaaaaaaaaagaacttgtactgtatttcctaaacattgataaagcctttaaaatgtttgtactgtaatactttgcttaaaagtcatgaggcattctgtgatccaacctctttcacttatttataagccctcttggttgctattccatattgtaggatgcctttctatttcaattggtaactttctgttttgttcttcctaattattctcccaagatcccacactgcagctttatctttaggcttatgaaaggtaacccgtggttaccggctctccaagtgattctgttcttctccatttttggcagttaatttgcagaagtaactgacagctgacaccatatgagaacctttgtataaaatattggcatgtaaacagcacagacaccgtaacacactctgtgccctgtttggttgttgacaatgaagcaccattatgtgactcttcatataacccttttttctacggcagcattaaaattgtctttttgctataa

SEQ ID NO: 307230 - DNA, 2267 bp, Homo sapiens
gtcccgaggggactggctccgccacgccccgcccctggctcccccgggagggcggctcaggggcggggacgggggcgtggtcccgccgtataagaacggagggggcggcggcgggacggctcactcggtgccgctgcctaggggctgtagaggtcgcgccgctcctgctggggcctgcccacgccaaggacctgcctctgtcgcctcctcttctattgcccagtttccccagccagaacatcccctgaagatggcagaggagagcagctgtaccagggattgcatgtccttcagcgtgctcaactgggatcaggttagccggctgcatgaggtcctcactgaagttgtacctatccacggacgaggcaactttccaaccttggagataactctgaaggacatcgtccagaccgtccgcagtcggctggaggaggcaggcatcaaagtgcacgacgtccggctgaatggctccgcagctggccacgttttggtcaaagacaatggcttgggctgcaaagacctggacctaatcttccatgtggctcttccaacagaggcagaatttcagctggttagagatgtggttctgtgttcccttctgaacttcctgccagagggtgtgaacaagctcaaaatcagtccagtcactctgaaggaggcatatgtgcagaagctagtgaaggtttgcacggacactgaccgctggagcctgatctccctctccaacaagaacgggaagaacgtggagctgaagtttgtcgactccattcggcgtcagtttgagttcagtgtggactctttccaaatcatcctggattctttgcttttcttctatgactgttccaataatcccatctctgagcacttccaccccaccgtgattggggagagcatgtacggggactttgaggaagcttttgaccatctgcagaacagactgatcgccaccaagaacccagaagaaatcagaggcgggggacttctcaagtacagcaaccttcttgtgcgggacttcaggcccacagaccaggaagaaatcaaaactctagagcgctacatgtgctccaggttcttcatcgacttcccggacatccttgaacagcagaggaagttggagacttaccttcaaaaccacttcgctgaagaagagagaagcaagtacgactacctcatgatccttcgcagggtggtgaacgagagcaccgtgtgtctcatggggcatgaacgcaggcagactctgaacctcatctccctcctggccttgcgtgtgctggcggaacaaaacatcatccccagtgccaccaacgtcacctgttactaccagccggccccttacgtcagtgatggcaacttcagcaactactacgttgcccatcctccagtcacctacagccagccttaccctacctggctgccctgtaactaaccttgagacctgagggtttccacagtgggaaccccaatagggctagggctctcaggtaggggagcctccttctagatgtaggcatttggcttttaaaggggaactcagctctgattctgcttttttttttttttttcctttgtgtacccattggaatgggtctacagtgtatcatgagccaaccctcaaaggacccgtattacagtgccacgttggaaaacgctacaggaagcatgacctatccacatctttccaagatagacactaacatgtcatgtcccaaacattagcacgtgggggttgagctctgtgcagtaatcgagattgggagaatttgggcagcgcgtgagaagtgctaagctacttgttttctcacttgagcccgggtaggctgtgttggccctcacttgggattctcagcagttacatgaaagttgtgctgataatctcttctcttgtaccaattttagtcaggcagaaaatggtaaacatgagggtgctcttgtgacttaatttttgttcaagggactaaattgcttatgtttattccctgtcagcggagtggagaatgtcattcatcaataaaccaaagccaatagctggagaattgagatctggttgaaagtggtttatggtttacatgctgtactatcctgaggaattgcgagatattgctgaggggaaaaaaaaatgaccttttcttgaaatgtaacttgaaaacaaaataaaatgtggaacataatgtttaattagaattgtggtggtggtagtggaaggggataattgtaaataggaaacatgaatgttcatttttttctttaaagaattcttattaaatggc

SEQ ID NO: 307231 - DNA, 2166 bp, Homo sapiens
gtcccgaggggactggctccgccacgccccgcccctggctcccccgggagggcggctcaggggcggggacgggggcgtggtcccgccgtataagaacggagggggcggcggcgggacggctcactcggtgccgctgcctaggggctgtagaggtcgcgccgctcctgctggggcctgcccacgccaaggacctgcctctgtcgcctcctcttctattgcccagtttccccagccagaacatcccctgaagatggcagaggagagcagctgtaccagggattgcatgtccttcagcgtgctcaactgggatcaggttagccggctgcatgaggtcctcactgaagttgtacctatccacggacgaggcaactttccaaccttggagataactctgaaggacatcgtccagaccgtccgcagtcggctggaggaggcaggcatcaaagtgcacgacgtccggctgaatggctccgcagctggccacgttttggtcaaagacaatggcttgggctgcaaagacctggacctaatcttccatgtggctcttccaacagaggcagaatttcagctggttagagatgtggttctgtgttcccttctgaacttcctgccagagggtgtgaacaagctcaaaatcagtccagtcactctgaaggaggcatatgtgcagaagctagtgaaggtttgcacggacactgaccgctggagcctgatctccctctccaacaagaacgggaagaacgtggagctgaagtttgtcgactccattcggcgtcagtttgagttcagtgtggactctttccaaatcatcctggattctttgcttttcttctatgactgttccaataatcccatctctgagcacttccaccccaccgtgattggggagagcatgtacggggactttgaggaagcttttgaccatctgcagaacagactgatcgccaccaagaacccagaagaaatcagaggcgggggacttctcaagtacagcaaccttcttgtgcgggacttcaggcccacagaccaggaagaaatcaaaactctagagcgctacatgtgctccaggttcttcatcgacttcccggacatccttgaacagcagaggaagttggagacttaccttcaaaaccacttcgctgaagaagagagaagcaagtacgactacctcatgatccttcgcagggtggtgaacgagagcaccgtgtgtctcatggggcatgaacgcaggcagactctgaacctcatctccctcctggccttgcgtgtgctggcggaacaaaacatcatccccagtgccaccaacgtcacctgttactaccagccggccccttacgtcagtgatggcaacttcagcaactactacgttgcccatcctccagtcacctacagccagccttaccctacctggctgccctgtaactaaccttgagacctgagggtttccacagtgggaaccccaatagggctagggctctcaggtaggggagcctccttctagatgtaggcatttggcttttaaaggggaactcagctctgattctgcttttttttttttttttcctttgtgtacccattggaatgggtctacagtgtatcatgagccaaccctcaaaggacccgtattacagtgccacgttggaaaacgctacaggaagcatgacctatccacatctttccaagatagacactaacatgtcatgtcccaaacattagcacgtgggggttgagctctgtgcagtaatcgagattgggagaatttgggcagcgcgtgagaagtgctaagctacttgttttctcacttgagcccgggtaggctgtgttggccctcacttgggattctcagcagttacatgaaagttgtgctgataatctcttctcttgtaccaattttagtcaggcagaaaatggtaaacatgagggtgctcttgtgacttaatttttgttcaagggactaaattgcttatgtttattccctgtcagcggagtggagaatgtcattcatcaataaaccaaagccaatagctggagaattgagatctggttgaaagtggtttatggtttacatgctgtactatcctgaggaattgcgagatattgctgaggggaaaaaaaaatgaccttttcttgaaatgtaacttgaaaacaaaataaaatgtggaacat

SEQ ID NO: 307232 - DNA, 528 bp, Homo sapiens
tgaggtaccttttttaattcaccagattagcaaagatgaacaagtcacgtagtatcacatatgacaagcatgtcaaatgtaaattgggatagccattcctgagacaatttggttgtatcagttaaaatgaaaatgggcataaactgtgacccaggaattccactgttaagtatcttctgagtagaaacacttatacatgttcaaaaggaagtatgtatcaaaaaaagacatactggtgaggatgcaaaggcatgggagccctcagacattgctggtggaaatataaaatggtacaggtgctttggaaacagtttttcagtttcttaaaatgttaagcatcagattgccatacccagcaatgtgcacttctagaaaaatagccaagagagctaaaaacactcctccacacaataatttgtacttgaatattcatagcatcattattcttagttgctatacagtggcaacaattggtgagtaaagagaatattgtttatccatacaattcaatactattcaacaataaaa

SEQ ID NO: 307233 - DNA, 494 bp, Homo sapiens
cgagctcggtacccactagtccacggttggctatgaatccatggtattactctggatactagccattccttaggattttaaggtcacattttattcctggatgctttatgtccccacctccacctgagccctcatcctctgttccctactatactcccaacttctactctttgttttatccacctatccctattacctgaccctttgtcttccctgtctcccatccttggggggacatgtagccctgtggtcatggttctgatgacatcatcagggcagcccccctgcccaggtattatggcctgtcagcattccctgtgccctccaaaccttaggcctagaatgcggagctgccaacataacattcacccttttgaacagatggagtcaggcacactaacacagccttctgtcctcaataacacagccaaccgtggactagacacctgtgactgatgtagccaaccagtggactagtagccaacctgatgtga

SEQ ID NO: 307234 - DNA, 388 bp, Homo sapiens
  misc_feature (296)..(296): n is a, c, g, or t
  misc_feature (354)..(354): n is a, c, g, or t
caggagaattgcttgaacccgggaggcagaggttgcagtgagctgggatcacaccactgcactccagcttggcaatagagtgagactccatctcaaaaaacaaaacaaaacaacaacaaaataaactactgtggcagcgttggtaccctgcatcactgccatggttgtgctattctcatctcaacatagaattggtggggttcattgcaacttgattctttgcggcaaccggatcacccgttcgaacgggtgatgcggttggaactcctgggctcaagcggtcctcccaccctggnctcccgaagccgctgggattacaggtgtgagccattgtagcagggcttttctccctgntccttatgatgcttccatggctttctgttctgca

SEQ ID NO: 307235 - DNA, 851 bp, Homo sapiens
caggagaattgcttgaacccgggaggcagaggttgcagtgagctgggatcacaccactgcactccagcttggcaatagagtgagactccatctcaaaaaacaaaacaaaacaacaacaaaataaactactgtggcagcgttggtaccctgcatcactgccatggttgtgctattctcatctcaacatagaattggtgggttctcctaagggtgtcaggaacctctaaaaagatgtgattctttgggaggggatatttgaaattccaacttccattccccctagcaaaaggaagcagctgctgtttaagggttttatctgagccactttaaagatgaatccatggtattactctggatactagccattccttaggattttaaggtcacattttattcctggatgctttatgtccccacctccacctgagccctcatcctctgttccctactatactcccaacttctactctttgttttatccacctatccctattacctgaccctttgtcttccctgtctcccatccttggggggacatgtagccctgtggtcatggttctgatgacatcatcagggcagcccccctgcccaggtattatggcctgtcagcattccctgtgccctccaaaccttaggcctagaatgcggagctgccaacataacattcacccttttgaacagatggagtcaggcacactaacacagccttctgtcctcaataacacagccattattgccacttgctcagtcgtcaatgtaaaccctcagagtcagctgaactattttaggccaaacatactgtttttgtaaagtatttttcattaataaatctataagacagttctatttaa

SEQ ID NO: 307236 - DNA, 1275 bp, Homo sapiens
caggagaattgcttgaacccgggaggcagaggttgcagtgagctgggatcacaccactgcactccagcttggcaatagagtgagactccatctcaaaaaacaaaacaaaacaacaacaaaataaactactgtggcagcgttggtaccctgcatcactgccatggttgtgctattctcatctcaacatagaattggtgggttctcctaagggtgtcaggaacctctaaaaagatgtgattctttgggaggggatatttgaaattccaacttccattccccctagcaaaaggaagcagctgctgtttaagggttttatctgagccactttaaagatgaatccatggtattactctggatactagccattccttaggattttaaggtcacattttattcctggatgctttatgtccccacctccacctgagccctcatcctctgttccctactatactcccaacttctactctttgttttatccacctatccctattacctgaccctttgtcttccctgtctcccatccttggggggacatgtagccctgtggtcatggttctgatgacatcatcagggcagcccccctgcccaggtattatggcctgtcagcattccctgtgccctccaaaccttaggcctagaatgcggagctgccaacataacattcacccttttgaacagatggagtcaggcacactaacacagccttctgtcctcaataacacagccattattgccacttgctcagtcgtcaatgtaaaccctcagagtcagctgaactattttaggccaaacatactgtttttgtaaagtatttttcattaataaatctataagacagttctatttaaaaaaaaaaaaaaaaaaaaaaaaaaaaaaaaaaaaaaaaaaaaaaaaacaaaaaaaaaaaaaaaaaaaaaaaaaaaaacaggtgggggccgcgcgcgggcgcgcccccgagagaaaatttccacaaacacccgtgggggggcggcgggcgccccaagtgagtgacagagaaagaaagacgaggagcacaacaggaggtccgtcctccagaagaaaacaaccgcgtgcggcacagaacaaaggaggtggcggggggtgcgctccaccacgacaaataagaaaaccccgcgggggggggaaaaacagcagacgagtgtcgtgaagaacaacaacccacaggagagaggcctcgtggacaaggcacacagggggtgctcacaaaacaagggggtacaaagaaggagacgcaagaaaacataattgccc

SEQ ID NO: 307237 - DNA, 639 bp, Homo sapiens
actaagaccgcaaggcattcatttcctcctacggtggatgcggacgccgggaggaggagagccccagagagaggagctgggagcggaggcgcagagaacacgtagcgactccgaagatcagccccaatgaacatgtcagtgttgactttacaagaatatgaattcgaaaagcagttcaacgagaatgaagccatccaatggatgcaggaaaactgggtgatgtctgcgcgacagggaaggcgggagagatgccacagtccagatcgcctacctgtgctcccctcccctcccccggttttcatctagatttgggttttctcgcttggcctctcccgcaaccggagtgtgaaaggcagtggagggaggaccttgtctcctgttgcctttaaccctctcccgcccgccgcccttggccctggtcctcgctgtctctccatccctcgtgtccttcctttctccttgcagcgctcctacttcaccgtcctcctctgtctgccgctcctcaggcggatgccccctttttagtacccctttccccacgcggttccctttccggtttcatagagagaccgggtgggagggaggaggggacaatgaaaacagtaataaatgaatgaacccgagcgagtggagccacgc

SEQ ID NO: 307238 - DNA, 3035 bp, Homo sapiens
actaagaccgcaaggcattcatttcctcctacggtggatgcggacgccgggaggaggagagccccagagagaggagctgggagcggaggcgcaggcaatgctcagccctggatgtagctgagaggctgggagaagagacgaccgctggagaccgagcggcgtggggaagacctaggggggtgggtgggggaagcagacaggagaacactcgaaatcaagcgctttacagattattttattttgtatagagaacacgtagcgactccgaagatcagccccaatgaacatgtcagtgttgactttacaagaatatgaattcgaaaagcagttcaacgagaatgaagccatccaatggatgcaggaaaactggaagaaatctttcctgttttctgctctgtatgctgcctttatattcggtggtcggcacctaatgaataaacgagcaaagtttgaactgaggaagccattagtgctctggtctctgacccttgcagtcttcagtatattcggtgctcttcgaactggtgcttatatggtgtacattttgatgaccaaaggcctgaagcagtcagtttgtgaccagggtttttacaatggacctgtcagcaaattctgggcttatgcatttgtgctaagcaaagcacccgaactaggagatacaatattcattattctgaggaagcagaagctgatcttcctgcactggtatcaccacatcactgtgctcctgtactcttggtactcctacaaagacatggttgccgggggaggttggttcatgactatgaactatggcgtgcacgccgtgatgtactcttactatgccttgcgggcggcaggtttccgagtctcccggaagtttgccatgttcatcaccttgtcccagatcactcagatgctgatgggctgtgtggttaactacctggtcttctgctggatgcagcatgaccagtgtcactctcactttcagaacatcttctggtcctcactcatgtacctcagctaccttgtgctcttctgccatttcttctttgaggcctacatcggcaaaatgaggaaaacaacgaaagctgaatagtgttggaactgaggaggaagccatagctcagggtcatcaagaaaaataatagacaaaagaaaatggcacaaggaatcacacgtggtgcagctaaaacaaaacaaaacatgagcaaacacaaaacccaaggcagcttagggataattaggttgatttaacccagtaagtttatgatccttttagggtgaggactcactgagtgcacctccatctccaagcactgctgctggaagaccccattccctctttatctatcaactctaggacaagggagaacaaaagcaagccagaagcagaggagactaatcaaaggcaaacaaaggctattaacacataggaaaaaatgtatttactaagtgtcacatttctctaagatgaaagatttttactctagaaactgtgcgagcacaacacacacaatcctttctaactttatggacactaaactggagccaatagaaaagacaaaaatgaaagagacacagggtgtatatctagaacgataatgcttttgcagaaactaaagcctttttaagaaatgccagctgctgtagaccccatgagaaaagatgtcttaatcatccttatgaaaacagatgtaaacaactatatttcaactaacttcatcttcactgcatagcctcaggctagtgagtttgccaaaaccaaagggggtgaatacttccccaagattcttcctgggaggatggaaacagtgcagcccaggtcccatgggggcagctccatcccagagcatttctgatagttgaactgtaatttctactcttaagtgagatatgaagcattatccttttgttcagttgccccgggcttttgaacagaagagtaaatacagaattgaaaaagataaacactcaaccaaacaatgtgaaaacgggttctgtagtatttgtaaaaaggcccggcccaggaccactgtgagctggaaaagggagaaaggcagtgggaaaagaggtgagccgaagatcaattcgacagacagacggtgtgtatgcccctccctgtttgacttcacacacactcataactttccaaatgaaaccccacagtatagcgcatattttcgatatttttgtgaattccaaaaggaaatcacagggctgttcgaaatattgggggaacactgtgtttctgcatcatctgcatttgctccccaagcaatgtagaggtgtttaaagggccctctgctggctgagtggcaatactacaacaaacttcaaggcaagtttggctgaaaacagttgacaacaaagggcccccatacacttatccctcaaattttaagtgatatgaaatacttgtcatgtctttggccaaatcagaagatattcatcctgcttcaagtcagcttcagaaatgttttaaaagggactttagctctggaactcaaaatcaatttattaagagccatattctttaaaaaaaaaaagctggataatattctctgtaatatttcagtcctttacaagccaaatacatgtgtcaatgtttctagtatttcaaagaagcaattatgtaaagttgttcaatgtgacataatagtattataattggttaagtagcttaatgattaggcaaactagatgaaaagattaggggcttccacactgcatagattacacgcacatagccacgcatacacacacagacacacagatgtggggtacactgaacttcaaagcccaaatgaatagaaacacattttctggctagcagaaaaaaacaaaacaaaactgttgtttctctttcttgctttgagagtgtacagtaaaagggattttttcgaattatttttatattattttagctttaattgtgctgtcgttcatgaaacagagctgctctgcttttctgtcagagatggcaagggctttttcagcatctcgtttatgtgtggaatttaaaaagaataaagttttattccattctgtgtgaa

SEQ ID NO: 307239 - DNA, 2727 bp, Homo sapiens
actaagaccgcaaggcattcatttcctcctacggtggatgcggacgccgggaggaggagagccccagagagaggagctgggagcggaggcgcagagaacacgtagcgactccgaagatcagccccaatgaacatgtcagtgttgactttacaagaatatgaattcgaaaagcagttcaacgagaatgaagccatccaatggatgcaggaaaactggaagaaatctttcctgttttctgctctgtatgctgcctttatattcggtggtcggcacctaatgaataaacgagcaaagtttgaactgaggaagccattagtgctctggtctctgacccttgcagtcttcagtatattcggtgctcttcgaactggtgcttatatggtgtacattttgatgaccaaaggcctgaagcagtcagtttgtgaccagggtttttacaatggacctgtcagcaaattctgggcttatgcatttgtgctaagcaaagcacccgaactaggagatacaatattcattattctgaggaagcagaagctgatcttcctgcactggtatcaccacatcactgtgctcctgtactcttggtactcctacaaagacatggttgccgggggaggttggttcatgactatgaactatggcgtgcacgccgtgatgtactcttactatgccttgcgggcggcaggtttccgagtctcccggaagtttgccatgttcatcaccttgtcccagatcactcagatgctgatgggctgtgtggttaactacctggtcttctgctggatgcagcatgaccagtgtcactctcactttcagaacatcttctggtcctcactcatgtacctcagctaccttgtgctcttctgccatttcttctttgaggcctacatcggcaaaatgaggaaaacaacgaaagctgaatagtgttggaactgaggaggaagccatagctcagggtcatcaagaaaaataatagacaaaagaaaatggcacaaggaatcacacgtggtgcagctaaaacaaaacaaaacatgagcaaacacaaaacccaaggcagcttagggataattaggttgatttaacccagtaagtttatgatccttttagggtgaggactcactgagtgcacctccatctccaagcactgctgctggaagaccccattccctctttatctatcaactctaggacaagggagaacaaaagcaagccagaagcagaggagactaatcaaaggcaaacaaaggctattaacacataggaaaaaatgtatttactaagtgtcacatttctctaagatgaaagatttttactctagaaactgtgcgagcacaacacacacaatcctttctaactttatggacactaaactggagccaatagaaaagacaaaaatgaaagagacacagggtgtatatctagaacgataatgcttttgcagaaactaaagcctttttaagaaatgccagctgctgtagaccccatgagaaaagatgtcttaatcatccttatgaaaacagatgtaaacaactatatttcaactaacttcatcttcactgcatagcctcaggctagtgagtttgccaaaaccaaagggggtgaatacttccccaagattcttcctgggaggatggaaacagtgcagcccaggtcccatgggggcagctccatcccagagcatttctgatagttgaactgtaatttctactcttaagtgagatatgaagcattatccttttgttcagttgccccgggcttttgaacagaagagtaaatacagaattgaaaaagataaacactcaaccaaacaatgtgaaaacgggttctgtagtatttgtaaaaaggcccggcccaggaccactgtgagctggaaaagggagaaaggcagtgggaaaagaggtgagccgaagatcaattcgacagacagacggtgtgtatgcccctccctgtttgacttcacacacactcataactttccaaatgaaaccccacagtatagcgcatattttcgatatttttgtgaattccaaaaggaaatcacagggctgttcgaaatattgggggaacactgtgtttctgcatcatctgcatttgctccccaagcaatgtagaggtgtttaaagggccctctgctggctgagtggcaatactacaacaaacttcaaggcaagtttggctgaaaacagttgacaacaaagggcccccatacacttatccctcaaattttaagtgatatgaaatacttgtcatgtctttggccaaatcagaagatattcatcctgcttcaagtcagcttcagaaatgttttaaaagggactttagctctggaactcaaaatcaatttattaagagccatattctttaaaaaaaaaaagctggataatattctctgtaatatttcagtcctttacaagccaaatacatgtgtcaatgtttctagtatttcaaagaagcaattatgtaaagttgttcaatgtgacataatagtattataattggttaagtagcttaatgattaggcaaactagatgaaaagattaggggcttccacactgcatagattacacgcacatagccacgcatacacacacagacacacagatgtggggtacactgaacttcaaagcccaaatgaatagaaacacattttctggctagcagaaaaaaacaaaacaaaactgttgtttctctttcttgctttgagagtgtacagtaaaagggattttt

SEQ ID NO: 307240 - DNA, 168 bp, Homo sapiens
gcggccgcctactactactactactgctcgaattcaagcttctaacgatgtacggggacatgaaacagagctgctctgcttttctgtcagagatggcaagggctttttcagcatctcgtttatgtgtggaatttaaaaagaataaagttttattccattctgtgtgaa

SEQ ID NO: 307241 - DNA, 2886 bp, Homo sapiens
  misc_feature (16)..(16): n is a, c, g, or t
ccacggacaacacaanggaaaccaacggctaggtgcgaggctgggtggcgggagaacactcgaaatcaagcgctttacagattattttattttgtatagagaacacgtagcgactccgaagatcagccccaatgaacatgtcagtgttgactttacaagaatatgaattcgaaaagcagttcaacgagaatgaagccatccaatggatgcaggaaaactggaagaaatctttcctgttttctgctctgtatgctgcctttatattcggtggtcggcacctaatgaataaacgagcaaagtttgaactgaggaagccattagtgctctggtctctgacccttgcagtcttcagtatattcggtgctcttcgaactggtgcttatatggtgtacattttgatgaccaaaggcctgaagcagtcagtttgtgaccagggtttttacaatggacctgtcagcaaattctgggcttatgcatttgtgctaagcaaagcacccgaactaggagatacaatattcattattctgaggaagcagaagctgatcttcctgcactggtatcaccacatcactgtgctcctgtactcttggtactcctacaaagacatggttgccgggggaggttggttcatgactatgaactatggcgtgcacgccgtgatgtactcttactatgccttgcgggcggcaggtttccgagtctcccggaagtttgccatgttcatcaccttgtcccagatcactcagatgctgatgggctgtgtggttaactacctggtcttctgctggatgcagcatgaccagtgtcactctcactttcagaacatcttctggtcctcactcatgtacctcagctaccttgtgctcttctgccatttcttctttgaggcctacatcggcaaaatgaggaaaacaacgaaagctgaatagtgttggaactgaggaggaagccatagctcagggtcatcaagaaaaataatagacaaaagaaaatggcacaaggaatcacacgtggtgcagctaaaacaaaacaaaacatgagcaaacacaaaacccaaggcagcttagggataattaggttgatttaacccagtaagtttatgatccttttagggtgaggactcactgagtgcacctccatctccaagcactgctgctggaagaccccattccctctttatctatcaactctaggacaagggagaacaaaagcaagccagaagcagaggagactaatcaaaggcaaacaaaggctattaacacataggaaaaaatgtatttactaagtgtcacatttctctaagatgaaagatttttactctagaaactgtgcgagcacaacacacacaatcctttctaactttatggacactaaactggagccaatagaaaagacaaaaatgaaagagacacagggtgtatatctagaacgataatgcttttgcagaaactaaagcctttttaagaaatgccagctgctgtagaccccatgagaaaagatgtcttaatcatccttatgaaaacagatgtaaacaactatatttcaactaacttcatcttcactgcatagcctcaggctagtgagtttgccaaaaccaaagggggtgaatacttccccaagattcttcctgggaggatggaaacagtgcagcccaggtcccatgggggcagctccatcccagagcatttctgatagttgaactgtaatttctactcttaagtgagatatgaagcattatccttttgttcagttgccccgggcttttgaacagaagagtaaatacagaattgaaaaagataaacactcaaccaaacaatgtgaaaacgggttctgtagtatttgtaaaaaggcccggcccaggaccactgtgagctggaaaagggagaaaggcagtgggaaaagaggtgagccgaagatcaattcgacagacagacggtgtgtatgcccctccctgtttgacttcacacacactcataactttccaaatgaaaccccacagtatagcgcatattttcgatatttttgtgaattccaaaaggaaatcacagggctgttcgaaatattgggggaacactgtgtttctgcatcatctgcatttgctccccaagcaatgtagaggtgtttaaagggccctctgctggctgagtggcaatactacaacaaacttcaaggcaagtttggctgaaaacagttgacaacaaagggcccccatacacttatccctcaaattttaagtgatatgaaatacttgtcatgtctttggccaaatcagaagatattcatcctgcttcaagtcagcttcagaaatgttttaaaagggactttagctctggaactcaaaatcaatttattaagagccatattctttaaaaaaaaaaagctggataatattctctgtaatatttcagtcctttacaagccaaatacatgtgtcaatgtttctagtatttcaaagaagcaattatgtaaagttgttcaatgtgacataatagtattataattggttaagtagcttaatgattaggcaaactagatgaaaagattaggggcttccacactgcatagattacacgcacatagccacgcatacacacacagacacacagatgtggggtacactgaacttcaaagcccaaatgaatagaaacacattttctggctagcagaaaaaaacaaaacaaaactgttgtttctctttcttgctttgagagtgtacagtaaaagggattttttcgaattatttttatattattttagctttaattgtgctgtcgttcatgaaacagagctgctctgcttttctgtcagagatggcaagggctttttcagcatctcgtttatgtgtggaatttaaaaagaataaagttttattccattctgtgtgaa

SEQ ID NO: 307242 - DNA, 4095 bp, Homo sapiens
actaagaccgcaaggcattcatttcctcctacggtggatgcggacgccgggaggaggagagccccagagagaggagctgggagcggaggcgcaggcaatgctcagccctggatgtagctgagaggctgggagaagagacgaccgctggagaccgagcggcgtggggaagacctaggggggtgggtgggggaagcagacaggagaacactcgaaatcaagcgctttacagattattttattttgtatagagaacacgtagcgactccgaagatcagccccaatgaacatgtcagtgttgactttacaagaatatgaattcgaaaagcagttcaacgagaatgaagccatccaatggatgcaggaaaactggaagaaatctttcctgttttctgctctgtatgctgcctttatattcggtggtcggcacctaatgaataaacgagcaaagtttgaactgaggaagccattagtgctctggtctctgacccttgcagtcttcagtatattcggtgctcttcgaactggtgcttatatggtgtacattttgatgaccaaaggcctgaagcagtcagtttgtgaccagggtttttacaatggacctgtcagcaaattctgggcttatgcatttgtgctaagcaaagcacccgaactaggagatacaatattcattattctgaggaagcagaagctgatcttcctgcactggtatcaccacatcactgtgctcctgtactcttggtactcctacaaagacatggttgccgggggaggttggttcatgactatgaactatggcgtgcacgccgtgatgtactcttactatgccttgcgggcggcaggtttccgagtctcccggaagtttgccatgttcatcaccttgtcccagatcactcagatgctgatgggctgtgtggttaactacctggtcttctgctggatgcagcatgaccagtgtcactctcactttcagaacatcttctggtcctcactcatgtacctcagctaccttgtgctcttctgccatttcttctttgaggcctacatcggcaaaatgaggaaaacaacgaaagctgaatagtgttggaactgaggaggaagccatagctcagggtcatcaagaaaaataatagacaaaagaaaatggcacaaggaatcacacgtggtgcagctaaaacaaaacaaaacatgagcaaacacaaaacccaaggcagcttagggataattaggttgatttaacccagtaagtttatgatccttttagggtgaggactcactgagtgcacctccatctccaagcactgctgctggaagaccccattccctctttatctatcaactctaggacaagggagaacaaaagcaagccagaagcagaggagactaatcaaaggcaaacaaaggctattaacacataggaaaaaatgtatttactaagtgtcacatttctctaagatgaaagatttttactctagaaactgtgcgagcacaacacacacaatcctttctaactttatggacactaaactggagccaatagaaaagacaaaaatgaaagagacacagggtgtatatctagaacgataatgcttttgcagaaactaaagcctttttaagaaatgccagctgctgtagaccccatgagaaaagatgtcttaatcatccttatgaaaacagatgtaaacaactatatttcaactaacttcatcttcactgcatagcctcaggctagtgagtttgccaaaaccaaagggggtgaatacttccccaagattcttcctgggaggatggaaacagtgcagcccaggtcccatgggggcagctccatcccagagcatttctgatagttgaactgtaatttctactcttaagtgagatatgaagcattatccttttgttcagttgccccgggcttttgaacagaagagtaaatacagaattgaaaaagataaacactcaaccaaacaatgtgaaaacgggttctgtagtatttgtaaaaaggcccggcccaggaccactgtgagctggaaaagggagaaaggcagtgggaaaagaggtgagccgaagatcaattcgacagacagacggtgtgtatgcccctccctgtttgacttcacacacactcataactttccaaatgaaaccccacagtatagcgcatattttcgatatttttgtgaattccaaaaggaaatcacagggctgttcgaaatattgggggaacactgtgtttctgcatcatctgcatttgctccccaagcaatgtagaggtgtttaaagggccctctgctggctgagtggcaatactacaacaaacttcaaggcaagtttggctgaaaacagttgacaacaaagggcccccatacacttatccctcaaattttaagtgatatgaaatacttgtcatgtctttggccaaatcagaagatattcatcctgcttcaagtcagcttcagaaatgttttaaaagggactttagctctggaactcaaaatcaatttattaagagccatattctttaaaaaaaaaaagctggataatattctctgtaatatttcagtcctttacaagccaaatacatgtgtcaatgtttctagtatttcaaagaagcaattatgtaaagttgttcaatgtgacataatagtattataattggttaagtagcttaatgattaggcaaactagatgaaaagattaggggcttccacactgcatagattacacgcacatagccacgcatacacacacagacacacagatgtggggtacactgaacttcaaagcccaaatgaatagaaacacattttctggctagcagaaaaaaacaaaacaaaactgttgtttctctttcttgctttgagagtgtacagtaaaagggattttttcgaattatttttatattattttagctttaattgtgctgtcgttcatgaaacagagctgctctgcttttctgtcagagatggcaagggctttttcagcatctcgtttatgtgtggaatttaaaaagaataaagttttattccattctgtgtgaatggtttgagcagtgaacaaagaatccatgcaaaccaagtcatgactggaagaaatggggagtgggggacagtgcaggggaggaaagctgttacatctatgttaaatgattgtgagcagtctataatgtcttgatgttggttcataggtgagacacaactgatggaggaatgtattataaattatgcaaaatctgacatgagctgaaaagacaggtccttttataagagctaatagatgcttaggatgcaaatgttattttgagcttcgcaaatacatgataccgtgcaataagccttttttccttataacagaaaatgagaataattaaaatgaggagaaggccacataacagttgacttgaatttaattgaaggacccattggaggctcatctggttgatttaattatttaattgagtgatttattgcagatctcttaatgcaggttagaaacggaagtgagcataaaccttaaaaagactctaaatgatgcttccaaagcactttcattttggtattaggttcatgtttgtttgtctttacttgtaaaataatttggaatttttgtttacagggtgaatgtcttaatagttttaaaattagctaaatatatctaaaggcatttccaatgtttatcatgggaggaaaaaagccacattttttttaaaacaaaacaaaacaaaacaaaattttggtaatataggttcaatacactgtttttaacatctcagcttagccgctttaatcatatcaagatatgaggctggatcactggcccatgacaaatctgaaacctaccagagaattgactgctgcatagataatcctgctgccagttaacattccagaaaaacttgggcaggcaagtttttatagctgccccactatgctgcaatagagtatctttctattgaagattttccactgcgatcccgatcctactatggtgaaagcattgttcttgggctaaaaaaaaatcctttatttcatacccacatgatttcatacactaagtctgagcattaagccaagtccctgagtttgcaatgaagttctagtg

SEQ ID NO: 307243 - DNA, 793 bp, Homo sapiens
actaagaccgcaaggcattcatttcctcctacggtggatgcggacgccgggaggaggagagccccagagagaggagctgggagcggaggcgcaggcaatgctcagccctggatgtagctgagaggctgggagaagagacgaccgctggagaccgagcggcgtggggaagacctaggggggtgggtgggggaagcagacaggagaacactcgaaatcaagcgctttacagattattttattttgtatagagaacacgtagcgactccgaagatcagccccaatgaacatgtcagtgttgactttacaagaatatgaattcgaaaagcagttcaacgagaatgaagccatccaatggatgcaggaaaactgggtgatgtctgcgcgacagggaaggcgggagagatgccacagtccagatcgcctacctgtgctcccctcccctcccccggttttcatctagatttgggttttctcgcttggcctctcccgcaaccggagtgtgaaaggcagtggagggaggaccttgtctcctgttgcctttaaccctctcccgcccgccgcccttggccctggtcctcgctgtctctccatccctcgtgtccttcctttctccttgcagcgctcctacttcaccgtcctcctctgtctgccgctcctcaggcggatgccccctttttagtacccctttccccacgcggttccctttccggtttcatagagagaccgggtgggagggaggaggggacaatgaaaacagtaataaatgaatgaacccgagcgagtggagccacgc

SEQ ID NO: 307244 - DNA, 914 bp, Homo sapiens
  misc_feature (16)..(16): n is a, c, g, or t
ccacggacaacacaanggaaaccaacggctaggtgcgaggctgggtggcgggagaacactcgaaatcaagcgctttacagattattttattttgtatagagaacacgtagcgactccgaagatcagccccaatgaacatgtcagtgttgactttacaagaatatgaattcgaaaagcagttcaacgagaatgaagccatccaatggatgcaggaaaactggtacgtgatgctttcgcctgatactgttcccgggagccctgcgcgtcttcccggagtgccttaatgtcggtattccctgcctgggcgtgaatggagcgatgaatcgcgggcagccagctgatcgctgagttctcgggtctcccgggtgcaggagacgctgggggggggggtacatgaagcgcgaggtctgtgggtgcccctgtgtgaaccgcggctacataggcatcttttatatagattatataacacagaacatatgtgtgtgcacagggtgatgtctgcgcgacagggaaggcgggagagatgccacagtccagatcgcctacctgtgctcccctcccctcccccggttttcatctagatttgggttttctcgcttggcctctcccgcaaccggagtgtgaaaggcagtggagggaggaccttgtctcctgttgcctttaaccctctcccgcccgccgcccttggccctggtcctcgctgtctctccatccctcgtgtccttcctttctccttgcagcgctcctacttcaccgtcctcctctgtctgccgctcctcaggcggatgccccctttttagtacccctttccccacgcggttccctttccggtttcatagagagaccgggtgggagggaggaggggacaatgaaaacagtaataaatgaatgaacccgagcgagtggagccacgc

SEQ ID NO: 307245 - DNA, 1612 bp, Homo sapiens
  misc_feature (12)..(12): n is a, c, g, or t
atgcgtattccngtagatccgagcaccagccggcgcttcagccccccctccagcagcctgcagcccggcaaaatgagcgacgtgagcccggtggtggctgcgcaacagcagcagcaacagcagcagcagcaacagcagcagcagcagcagcaacagcagcagcagcagcaggaggcggcggcggcggctgcggcggcagcggcggctgcggcggcggcagctgcagtgccccggttgcggccgccccacgacaaccgcaccatggtggagatcatcgccgaccacccggccgaactcgtccgcaccgacagccccaacttcctgtgctcggtgctgccctcgcactggcgctgcaacaagaccctgcccgtggccttcaaggtggtagccctcggagaggtaccagatgggactgtggttactgtcatggcgggtaacgatgaaaattattctgctgagctccggaatgcctctgctgttatgaaaaaccaagtagcaaggttcaacgatctgagatttgtgggccggagtggacgaggcaagagtttcaccttgaccataaccgtcttcacaaatcctccccaagtagctacctatcacagagcaattaaagttacagtagatggacctcgggaacccagaaggcacagacagaagcttgatgactctaaacctagtttgttctctgaccgcctcagtgatttagggcgcattcctcatcccagtatgagagtaggtgtcccgcctcagaacccacggccctccctgaactctgcaccaagtccttttaatccacaaggacagagtcagattacagaccccaggcaggcacagtcttccccgccgtggtcctatgaccagtcttacccctcctacctgagccagatgacgtccccgtccatccactctaccaccccgctgtcttccacacggggcactgggcttcctgccatcaccgatgtgcctaggcgcatttcagatgatgacactgccacctctgacttctgcctctggccttccactctcagtaagaagagccaggcaggtgcttcagaactgggccctttttcagaccccaggcagttcccaagcatttcatccctcactgagagccgcttctccaacccacgaatgcactatccagccacctttacttacaccccgccagtcacctcaggcatgtccctcggtatgtccgccaccactcactaccacacctacctgccaccaccctaccccggctcttcccaaagccagagtggacccttccagaccagcagcactccatatctctactatggcacttcgtcaggatcctatcagtttcccatggtgccggggggagaccggtctccttccagaatgcttccgccatgcaccaccacctcgaatggcagcacgctattaaatccaaatttgcctaaccagaatgatggtgttgacgctgatggaagccacagcagttccccaactgttttgaattctagtggcagaatggatgaatctgtttggcgaccatattgaaattcctcagcagtggcccagtggtatctgggggccacatcccacacgtatcaatatatacatatatagagagagtgcatatatatgt

SEQ ID NO: 307246 - DNA, 1546 bp, Homo sapiens
  misc_feature (12)..(12): n is a, c, g, or t
atgcgtattccngtagatccgagcaccagccggcgcttcagccccccctccagcagcctgcagcccggcaaaatgagcgacgtgagcccggtggtggctgcgcaacagcagcagcaacagcagcagcagcaacagcagcagcagcagcagcaacagcagcagcagcagcaggaggcggcggcggcggctgcggcggcagcggcggctgcggcggcggcagctgcagtgccccggttgcggccgccccacgacaaccgcaccatggtggagatcatcgccgaccacccggccgaactcgtccgcaccgacagccccaacttcctgtgctcggtgctgccctcgcactggcgctgcaacaagaccctgcccgtggccttcaaggtggtagccctcggagaggtaccagatgggactgtggttactgtcatggcgggtaacgatgaaaattattctgctgagctccggaatgcctctgctgttatgaaaaaccaagtagcaaggttcaacgatctgagatttgtgggccggagtggacgaggcaagagtttcaccttgaccataaccgtcttcacaaatcctccccaagtagctacctatcacagagcaattaaagttacagtagatggacctcgggaacccagaaggcacagacagaagcttgatgactctaaacctagtttgttctctgaccgcctcagtgatttagggcgcattcctcatcccagtatgagagtaggtgtcccgcctcagaacccacggccctccctgaactctgcaccaagtccttttaatccacaaggacagagtcagattacagaccccaggcaggcacagtcttccccgccgtggtcctatgaccagtcttacccctcctacctgagccagatgacgtccccgtccatccactctaccaccccgctgtcttccacacggggcactgggcttcctgccatcaccgatgtgcctaggcgcatttcaggtgcttcagaactgggccctttttcagaccccaggcagttcccaagcatttcatccctcactgagagccgcttctccaacccacgaatgcactatccagccacctttacttacaccccgccagtcacctcaggcatgtccctcggtatgtccgccaccactcactaccacacctacctgccaccaccctaccccggctcttcccaaagccagagtggacccttccagaccagcagcactccatatctctactatggcacttcgtcaggatcctatcagtttcccatggtgccggggggagaccggtctccttccagaatgcttccgccatgcaccaccacctcgaatggcagcacgctattaaatccaaatttgcctaaccagaatgatggtgttgacgctgatggaagccacagcagttccccaactgttttgaattctagtggcagaatggatgaatctgtttggcgaccatattgaaattcctcagcagtggcccagtggtatctgggggccacatcccacacgtatcaatatatacatatatagagagagtgcatatatatgt

SEQ ID NO: 307247 - DNA, 739 bp, Homo sapiens
taaaacataaaaattactttaaaaaaatttaaagaggccgggcacagtggcttatgcctgtaatcccagaaatttgggaggccgaggcaggaggatcacttgagcccgggagtccaagaccagcctcgttaatataatgagagcttatcatctctacaaaaaataaacaaaattagccaggcatggtggcatgtgcctgtagttccagctactcaggaggctgaggtaggaggatcactggagcccagggggtggaggagcagtaagccaagattctgccactgcactccagcctggctgacagagtaagaccctatctcaaaaaacaaaaagcagaaagaacaaagaagtaaacaaaagcttaaaagtaaatcagccaggtgcagtagctcatgcctgtaatcccagtactttgggaggcctaggcaggcagattactgcaggtcaagagtttgagaccagcctggccaacatgatgaaaccctgtctctactaaaactacaaaaattagccaggcatggtggtgcgcacctgtaatcccagctactccggaggctgagacaagagaatcgcttgaacctaggaagtggaggttgcagtggcagtgagccaagatagcgccactgcactccagcctgggcaacagagcaagactccatatatggagatcccttgagatcaagagttcgagaccagcctggccaacacggcaaaaccctgtctctactaaaaataaaaa

SEQ ID NO: 307248 - DNA, 6731 bp, Homo sapiens
taacgcctttcacaaatgtttattttgctaggtgtatgaacagttaaagccagcctgaaagataaaaaatactaactcttgatttcgatttcttacattttctgctccaaagtacaaaggaacttaaatttgaagttataaaacggatcccacattgtttctgtaattatcatttcgcagtattggtaataggaataacatctttgtcgaataaccattcctaaaacttacttttagactcattcttacatattaatttgcaaataagcaaatgttaaggacagtatcaaaaaagactttaaaacacatctagtgaacgttctgagttacttctagtttcgaaaattctattgaattccaaggtcacatgtattatgtacattaaacttgtttccctaaataaaagttactgatatgggaaagttgctttaggggaattttcgctagtaaatccataatccttaaaattctaagtgaattaaacattgatactttgcaaatatttacagcagtgtaaatattactttttaaaggtgcgttagtttcaagaatgctggggtcctacaagcatgatgacactttgtaacacatactttttttttggtcttttcctctgctttctaaatctcttaattgccataagtattaaatagaactgatgtcaaggtatcttctgttcaagatggatgtttactaaacatgcaaagtatttttagagatatagattctaatttggaagaagaaaaatagcaacaaattttcttattcatttcttttctcatctttaaaatacaagttaaatcgtaattggaatcccttttcccatcgtgtagtcaagagtctgtgccagacttgaaggctttactttgttagccatgtgtttatgaacccccagcgctttccctagatcttttggctgataatctcaaacatggaggatgcttctgaatcttcacgaggggttgctccattaattaataatgtagttctcccaggctctccgctgtctcttcctgtatcagtgacaggctgtaaaagtcatcgagtagccaataaaaaggtagaagcgaggagtgaaaagctcctcccaacagctcttcctccttcagagccgaaagtagatcagaaacttcccaggagctccgagaggcggggaagtggcggtgggacgcaattccccgcgcggagtcgggcagtggcagcgggagaagcggcagccaggggcgcggcggggccggagagaggcggtcccctgggaggacggggtctcccctcgttgcctttgtagtggagaaggtggacaagtggcagtcggcgtgatcgcagggaagcggggccggcgcgggcggccgagggtccaggcgagcccgcgggcggacgggagatgccgctgctacaccgaaagccgtttgtgagacagaagccgcccgcggacctgcggcccgacgaggaagttttctactgtaaagtcaccaacgagatcttccgccactacgatgacttttttgaacgaaccattctgtgcaacagccttgtgtggagttgtgctgtgacgggtagacctggactgacgtatcaggaagcacttgagtcagaaaaaaaagcaagacagaatcttcagagttttccagaaccactaattattccagttttatacttgaccagccttacccatcgttcgcgcttacatgaaatttgtgatgatatctttgcatatgtcaaggatcgatattttgtcgaagaaactgtggaagtcattaggaacaatggtgcaaggttgcagtgtaggattttggaagtcctccctccatcacatcaaaatggttttgctaatggacatgttaacagtgtggatggagaaactattatcatcagtgatagtgatgattcagaaacacaaagctgttcttttcaaaatgggaagaaaaaagatgcaattgatcccttactattcaagtataaagtgcaacccactaaaaaagaattacatgagtctgctattgttaaagcaacacaaatcagccggagaaaacacctattttctcgtgataaactaaagctttttctgaagcaacactgtgaaccacaagatggagtcattaaaataaaggcatcatctctttcaacgtataaaatagcagaacaagatttttcttatttcttccctgatgatccacccacatttatcttcagtcctgctaacagacgaagagggagacctcccaaacgaatacatattagtcaagaggacaatgttgctaataaacagactcttgcaagttataggagcaaagctactaaagaaagagataaacttttgaaacaagaagaaatgaagtcactggcttttgaaaaggctaaattaaaaagagaaaaagcagatgccctagaagcgaagaaaaaagaaaaagaagataaagagaaaaagagggaagaattgaaaaaaattgttgaagaagagagactaaagaaaaaagaagaaaaagagaggcttaaagtagaaagagaaaaggaaagagagaagttacgtgaagaaaagcgaaagtatgtggaatacttaaaacagtggagtaaacctagagaagatatggaatgtgatgaccttaaggaacttccagaaccaacaccagtgaaaactagactacctcctgaaatctttggtgatgctctgatggttttggagttccttaatgcatttggggaactttttgatcttcaagatgagtttcctgatggagtaaccctagaagtattagaggaagctcttgtaggaaatgacagtgaaggcccactgtgtgaattgctttttttcttcctgactgcaatcttccaggcaatagctgaagaagaagaggaagtagccaaagagcaactaactgatgctgacaccaaaggctgcagtttgaaaagtttggatcttgatagctgcactctttcagaaatcctcagactgcacatcttagcttcaggtgctgatgtaacatcagcaaatgcaaagtatagatatcaaaaacgaggaggatttgatgctacagatgatgcttgtatggagcttcgtttgagcaatcccagtctagtgaagaaactgtcaagcacctcagtgtatgatttgacaccaggagaaaaaatgaagatactccatgctctctgtggaaagctactgaccctagtttcaactagggattttattgaagattatgttgatatattacgacaggcaaagcaggagttccgggaattaaaagcagaacaacatcgaaaagagagggaagaagcagctgccagaattcgtaaaaggaaggaagaaaaacttaaggagcaagaacaaaaaatgaaagagaaacaagaaaaactgaaagaagatgagcaaagaaattcaacggcagatatatctattggggaggaagaaagggaagattttgatactagcattgagagcaaagacacagagcaaaaggaattagatcaagatatggtcactgaagatgaagatgacccaggatcacataaaagaggcagaagggggaaaagaggacaaaatggatttaaagaatttacaaggcaagaacagatcaactgtgtaacaagagagcctcttactgctgatgaggaagaagcattaaaacaggaacaccaacgaaaagagaaagagctcttagaaaaaatccaaagtgccatagcctgtaccaatatctttcccttgggtcgcgaccgcatgtatagacgatactggattttcccttctattcctggactctttattgaagaggattattctggtcttactgaagacatgctgttgcctagaccttcatcatttcagaataatgtacagtctcaagatcctcaggtatccactaaaactggagagcctttgatgtctgaatctacctccaacattgaccaaggtccacgtgaccattctgtgcagctgccaaaaccagtgcataagccaaatcggtggtgcttttacagttcttgtgaacagctagaccagcttattgaagctcttaattctagaggacatagagaaagtgccttaaaagaaactttgttacaagagaaaagcagaatatgtgcacagctagcccgtttttctgaagagaaatttcatttttcagacaaacctcagcctgatagcaaaccaacatatagtcggggaagatcttccaatgcatatgatccatctcagatgtgtgcagaaaagcaacttgaactaaggctgagagattttcttttagatattgaagatagaatctaccaaggaacattaggagccatcaaggttacagatcgacatatctggagatcagcattagaaagtggacggtatgagctgttaagtgaggaaaacaaggaaaatgggataattaaaactgtgaatgaagacgtagaagagatggaaattgatgaacaaacaaaggtcatagtaaaagacagacttttggggataaaaacagaaactccaagtactgtatcaacaaatgcaagtacaccacaatcagtgagcagtgtggttcattatctggcaatggcactctttcaaatagagcagggcattgagcggcgttttctgaaagctccacttgatgccagtgacagtgggcgttcttataaaacagttctggaccgttggagagagtctctcctttcttctgctagtctatcccaagtttttcttcacctatccaccttggatcgtagcgtgatatggtctaaatctatactgaatgcgcgttgcaagatatgtcgaaagaaaggcgatgctgaaaacatggttctttgtgatggctgtgataggggtcatcatacctactgtgttcgaccaaagctcaagactgtgcctgaaggagactggttttgtccagaatgtcgaccaaagcaacgttctagaagactctcctctagacagagaccatccttggaaagtgatgaagatgtggaagacagtatgggaggtgaggatgatgaagttgatggcgatgaagaagaaggtcaaagtgaggaggaagagtatgaggtagaacaagatgaagatgactctcaagaagaggaagaagtcagcctacccaaacgaggaagaccacaagttagattgccagttaaaacaagagggaaacttagctcttctttctcaagtcgtggccaacaacaagaacctggaagatacccttcaaggagtcagcagagcacacccaaaacaactgtttcttctaaaactggtagaagcctaagaaagataaactctgctcctcctacagaaacaaaatctttaagaattgccagtcgttctactcgccacagtcatggcccactgcaagcagatgtatttgtggaattgcttagtcctcgtagaaaacgcagaggcaggaaaagtgctaataatacaccagaaaatagtcccaacttccctaacttcagagtcattgccacaaagtcaagtgaacagtcaagatctgtaaatattgcttcaaaactttctctccaagagagtgaatccaaaagaagatgcagaaaaagacaatctccagagccatcgcctgtgacactgggtcgaaggagttctggccgacagggaggagttcatgaattgtctgcttttgaacaacttgttgtagaattggtacgacatgatgacagctggccttttttgaaacttgtttctaaaatccaggtcccagactactatgacatcatcaaaaagcccattgccttaaatataattcgtgaaaaagtgaataagtgtgaatataaattagcatctgagtttattgatgacattgagttaatgttttcgaactgctttgaatacaaccctcgtaacacaagtgaagcaaaagctggaactaggcttcaagcattttttcatattcaggctcaaaagcttggactccacgtcacacccagtaatgtggaccaagttagcacaccaccggctgcgaaaaagtcacgaatctgactttgtccttctaaaggatatatttgaagaaaaacaaattgttcatgaaaatggaacattaaatcatgctgtataaagcaataacaattgattgaccacatgaaagtgtggcctgcactatattctcaattttaatattaagcactcaggagaatgtaggaaagatatcctttgctacagttttgttcagtatctaataagtttgatagatgtattggatacagtactggtttacagaggtttttgtacatttttgagatcattcatgtgtccagagatcttggaaaatattttttcacccacgatttattttgttattgatgatttttttttaaagtggtggtattaagggagagttatctacatggatgagtcttccgctatagcacagtttagaaaaggtgtttatgtcttaattaattgtttgagtacattctttcaacactacacatgaatgaatccaatcttataaccttgaagtgctgtaccagtgctggctgcaggtattaagtccaagtttattaactagatatttatttagtattgagagtaatttgtgaatttgttttgtatttataaaatttatacctgaaaaatgttccttaatgttttaaaccttttactgtgtttttattcctctaacttccttaatgatcaatcaaaaaaagtaacaccctccctttttcctgacagttctttcagctttacagaactgtattataagtttctatgtataactttttaactgtacaaataaaataacattttttca

SEQ ID NO: 307249 - DNA, 520 bp, Homo sapiens
aagtttgagtttccagggcttacaaactggggctattttgtttgattcacacagccttttaaaacattgcttcccaaacttgaatgtacatatgaatcacttggggatcttgtcaaaatgatgaagattctaaattagtaggtctggtgggggaatgagattctgcattttttaacaaggtgatgataaccttgctgctggtcttcagatcacactttgggtattagggctttcaaaggcacagatatgtttgtcccagtactgtagtttgtcataaacttagccaatttgcttttcctgttttaataatctgctggctccctgtaggaattttaagagtctctactaatctcatttaactttaaattatttcaaggattctgttgttacatcaaaaaaattgccaagtgttattttgtctatatatatagttctaagtttgatttttcttcacagcttttgaaaaggctaaattaaaaagagaaaaagcagatgccctagaagcgaagaaaaaagaaaa

SEQ ID NO: 307250 - DNA, 6827 bp, Homo sapiens
taacgcctttcacaaatgtttattttgctaggtgtatgaacagttaaagccagcctgaaagataaaaaatactaactcttgatttcgatttcttacattttctgctccaaagtacaaaggaacttaaatttgaagttataaaacggatcccacattgtttctgtaattatcatttcgcagtattggtaataggaataacatctttgtcgaataaccattcctaaaacttacttttagactcattcttacatattaatttgcaaataagcaaatgttaaggacagtatcaaaaaagactttaaaacacatctagtgaacgttctgagttacttctagtttcgaaaattctattgaattccaaggtcacatgtattatgtacattaaacttgtttccctaaataaaagttactgatatgggaaagttgctttaggggaattttcgctagtaaatccataatccttaaaattctaagtgaattaaacattgatactttgcaaatatttacagcagtgtaaatattactttttaaaggtgcgttagtttcaagaatgctggggtcctacaagcatgatgacactttgtaacacatactttttttttggtcttttcctctgctttctaaatctcttaattgccataagtattaaatagaactgatgtcaaggtatcttctgttcaagatggatgtttactaaacatgcaaagtatttttagagatatagattctaatttggaagaagaaaaatagcaacaaattttcttattcatttcttttctcatctttaaaatacaagttaaatcgtaattggaatcccttttcccatcgtgtagtcaagagtctgtgccagacttgaaggctttactttgttagccatgtgtttatgaacccccagcgctttccctagatcttttggctgataatctcaaacatggaggatgcttctgaatcttcacgaggggttgctccattaattaataatgtagttctcccaggctctccgctgtctcttcctgtatcagtgacaggctgtaaaagtcatcgagtagccaataaaaaggtagaagcgaggagtgaaaagctcctcccaacagctcttcctccttcagagccgaaagtagatcagaaacttcccaggagctccgagaggcggggaagtggcggtgggacgcaattccccgcgcggagtcgggcagtggcagcgggagaagcggcagccaggggcgcggcggggccggagagaggcggtcccctgggaggacggggtctcccctcgttgcctttgtagtggagaaggtggacaagtggcagtcggcgtgatcgcagggaagcggggccggcgcgggcggccgagggtccaggcgagcccgcgggcggacgggagatgccgctgctacaccgaaagccgtttgtgagacagaagccgcccgcggacctgcggcccgacgaggaagttttctactgtaaagtcaccaacgagatcttccgccactacgatgacttttttgaacgaaccattctgtgcaacagccttgtgtggagttgtgctgtgacgggtagacctggactgacgtatcaggaagcacttgagtcagaaaaaaaagcaagacagaatcttcagagttttccagaaccactaattattccagttttatacttgaccagccttacccatcgttcgcgcttacatgaaatttgtgatgatatctttgcatatgtcaaggatcgatattttgtcgaagaaactgtggaagtcattaggaacaatggtgcaaggttgcagtgtaggattttggaagtcctccctccatcacatcaaaatggttttgctaatggacatgttaacagtgtggatggagaaactattatcatcagtgatagtgatgattcagaaacacaaagctgttcttttcaaaatgggaagaaaaaagatgcaattgatcccttactattcaagtataaagtgcaacccactaaaaaagaattacatgagtctgctattgttaaagcaacacaaatcagccggagaaaacacctattttctcgtgataaactaaagctttttctgaagcaacactgtgaaccacaagatggagtcattaaaataaaggcatcatctctttcaacgtataaaatagcagaacaagatttttcttatttcttccctgatgatccacccacatttatcttcagtcctgctaacagacgaagagggagacctcccaaacgaatacatattagtcaagaggacaatgttgctaataaacagactcttgcaagttataggagcaaagctactaaagaaagagataaacttttgaaacaagaagaaatgaagtcactggcttttgaaaaggctaaattaaaaagagaaaaagcagatgccctagaagcgaagaaaaaagaaaaagaagataaagagaaaaagagggaagaattgaaaaaaattgttgaagaagagagactaaagaaaaaagaagaaaaagagaggcttaaagtagaaagagaaaaggaaagagagaagttacgtgaagaaaagcgaaagtatgtggaatacttaaaacagtggagtaaacctagagaagatatggaatgtgatgaccttaaggaacttccagaaccaacaccagtgaaaactagactacctcctgaaatctttggtgatgctctgatggttttggagttccttaatgcatttggggaactttttgatcttcaagatgagtttcctgatggagtaaccctagaagtattagaggaagctcttgtaggaaatgacagtgaaggcccactgtgtgaattgctttttttcttcctgactgcaatcttccaggcaatagctgaagaagaagaggaagtagccaaagagcaactaactgatgctgacaccaaagatttaacagaggctttggatgaagatgcagaccccacaaaatctgcactgtctgcagttgcatctttggcagctgcatggccacagttacaccagggctgcagtttgaaaagtttggatcttgatagctgcactctttcagaaatcctcagactgcacatcttagcttcaggtgctgatgtaacatcagcaaatgcaaagtatagatatcaaaaacgaggaggatttgatgctacagatgatgcttgtatggagcttcgtttgagcaatcccagtctagtgaagaaactgtcaagcacctcagtgtatgatttgacaccaggagaaaaaatgaagatactccatgctctctgtggaaagctactgaccctagtttcaactagggattttattgaagattatgttgatatattacgacaggcaaagcaggagttccgggaattaaaagcagaacaacatcgaaaagagagggaagaagcagctgccagaattcgtaaaaggaaggaagaaaaacttaaggagcaagaacaaaaaatgaaagagaaacaagaaaaactgaaagaagatgagcaaagaaattcaacggcagatatatctattggggaggaagaaagggaagattttgatactagcattgagagcaaagacacagagcaaaaggaattagatcaagatatggtcactgaagatgaagatgacccaggatcacataaaagaggcagaagggggaaaagaggacaaaatggatttaaagaatttacaaggcaagaacagatcaactgtgtaacaagagagcctcttactgctgatgaggaagaagcattaaaacaggaacaccaacgaaaagagaaagagctcttagaaaaaatccaaagtgccatagcctgtaccaatatctttcccttgggtcgcgaccgcatgtatagacgatactggattttcccttctattcctggactctttattgaagaggattattctggtcttactgaagacatgctgttgcctagaccttcatcatttcagaataatgtacagtctcaagatcctcaggtatccactaaaactggagagcctttgatgtctgaatctacctccaacattgaccaaggtccacgtgaccattctgtgcagctgccaaaaccagtgcataagccaaatcggtggtgcttttacagttcttgtgaacagctagaccagcttattgaagctcttaattctagaggacatagagaaagtgccttaaaagaaactttgttacaagagaaaagcagaatatgtgcacagctagcccgtttttctgaagagaaatttcatttttcagacaaacctcagcctgatagcaaaccaacatatagtcggggaagatcttccaatgcatatgatccatctcagatgtgtgcagaaaagcaacttgaactaaggctgagagattttcttttagatattgaagatagaatctaccaaggaacattaggagccatcaaggttacagatcgacatatctggagatcagcattagaaagtggacggtatgagctgttaagtgaggaaaacaaggaaaatgggataattaaaactgtgaatgaagacgtagaagagatggaaattgatgaacaaacaaaggtcatagtaaaagacagacttttggggataaaaacagaaactccaagtactgtatcaacaaatgcaagtacaccacaatcagtgagcagtgtggttcattatctggcaatggcactctttcaaatagagcagggcattgagcggcgttttctgaaagctccacttgatgccagtgacagtgggcgttcttataaaacagttctggaccgttggagagagtctctcctttcttctgctagtctatcccaagtttttcttcacctatccaccttggatcgtagcgtgatatggtctaaatctatactgaatgcgcgttgcaagatatgtcgaaagaaaggcgatgctgaaaacatggttctttgtgatggctgtgataggggtcatcatacctactgtgttcgaccaaagctcaagactgtgcctgaaggagactggttttgtccagaatgtcgaccaaagcaacgttctagaagactctcctctagacagagaccatccttggaaagtgatgaagatgtggaagacagtatgggaggtgaggatgatgaagttgatggcgatgaagaagaaggtcaaagtgaggaggaagagtatgaggtagaacaagatgaagatgactctcaagaagaggaagaagtcagcctacccaaacgaggaagaccacaagttagattgccagttaaaacaagagggaaacttagctcttctttctcaagtcgtggccaacaacaagaacctggaagatacccttcaaggagtcagcagagcacacccaaaacaactgtttcttctaaaactggtagaagcctaagaaagataaactctgctcctcctacagaaacaaaatctttaagaattgccagtcgttctactcgccacagtcatggcccactgcaagcagatgtatttgtggaattgcttagtcctcgtagaaaacgcagaggcaggaaaagtgctaataatacaccagaaaatagtcccaacttccctaacttcagagtcattgccacaaagtcaagtgaacagtcaagatctgtaaatattgcttcaaaactttctctccaagagagtgaatccaaaagaagatgcagaaaaagacaatctccagagccatcgcctgtgacactgggtcgaaggagttctggccgacagggaggagttcatgaattgtctgcttttgaacaacttgttgtagaattggtacgacatgatgacagctggccttttttgaaacttgtttctaaaatccaggtcccagactactatgacatcatcaaaaagcccattgccttaaatataattcgtgaaaaagtgaataagtgtgaatataaattagcatctgagtttattgatgacattgagttaatgttttcgaactgctttgaatacaaccctcgtaacacaagtgaagcaaaagctggaactaggcttcaagcattttttcatattcaggctcaaaagcttggactccacgtcacacccagtaatgtggaccaagttagcacaccaccggctgcgaaaaagtcacgaatctgactttgtccttctaaaggatatatttgaagaaaaacaaattgttcatgaaaatggaacattaaatcatgctgtataaagcaataacaattgattgaccacatgaaagtgtggcctgcactatattctcaattttaatattaagcactcaggagaatgtaggaaagatatcctttgctacagttttgttcagtatctaataagtttgatagatgtattggatacagtactggtttacagaggtttttgtacatttttgagatcattcatgtgtccagagatcttggaaaatattttttcacccacgatttattttgttattgatgatttttttttaaagtggtggtattaagggagagttatctacatggatgagtcttccgctatagcacagtttagaaaaggtgtttatgtcttaattaattgtttgagtacattctttcaacactacacatgaatgaatccaatcttataaccttgaagtgctgtaccagtgctggctgcaggtattaagtccaagtttattaactagatatttatttagtattgagagtaatttgtgaatttgttttgtatttataaaatttatacctgaaaaatgttccttaatgttttaaaccttttactgtgtttttattcctctaacttccttaatgatcaatcaaaaaaagtaacaccctccctttttcctgacagttctttcagctttacagaactgtattataagtttctatgtataactttttaactgtacaaataaaataacattttttca

SEQ ID NO: 307251 - DNA, 7260 bp, Homo sapiens
taacgcctttcacaaatgtttattttgctaggtgtatgaacagttaaagccagcctgaaagataaaaaatactaactcttgatttcgatttcttacattttctgctccaaagtacaaaggaacttaaatttgaagttataaaacggatcccacattgtttctgtaattatcatttcgcagtattggtaataggaataacatctttgtcgaataaccattcctaaaacttacttttagactcattcttacatattaatttgcaaataagcaaatgttaaggacagtatcaaaaaagactttaaaacacatctagtgaacgttctgagttacttctagtttcgaaaattctattgaattccaaggtcacatgtattatgtacattaaacttgtttccctaaataaaagttactgatatgggaaagttgctttaggggaattttcgctagtaaatccataatccttaaaattctaagtgaattaaacattgatactttgcaaatatttacagcagtgtaaatattactttttaaaggtgcgttagtttcaagaatgctggggtcctacaagcatgatgacactttgtaacacatactttttttttggtcttttcctctgctttctaaatctcttaattgccataagtattaaatagaactgatgtcaaggtatcttctgttcaagatggatgtttactaaacatgcaaagtatttttagagatatagattctaatttggaagaagaaaaatagcaacaaattttcttattcatttcttttctcatctttaaaatacaagttaaatcgtaattggaatcccttttcccatcgtgtagtcaagagtctgtgccagacttgaaggctttactttgttagccatgtgtttatgaacccccagcgctttccctagatcttttggctgataatctcaaacatggaggatgcttctgaatcttcacgaggggttgctccattaattaataatgtagttctcccaggctctccgctgtctcttcctgtatcagtgacaggctgtaaaagtcatcgagtagccaataaaaaggtagaagcgaggagtgaaaagctcctcccaacagctcttcctccttcagagccgaaagtagatcagaaacttcccaggagctccgagagggcagtggcagcgggagaagcggcagccaggggcgcggcggggccggagagaggcggtcccctgggaggacggggtctcccctcgttgcctttgtagtggagaaggtggacaagtggcagtcggcgtgatcgcaggtgagggtcgctcgggagccggccggcgccggcggggaagtggaggcgagccgggaacaaagcggagcagctccggggtccgcccgcggcgagcgctctggcggcgttgggctggccggccggccagctgcgcgccgagcacgttgtgagcctggcggcggcggcgggcgaggagccggcgctgggggagggggccgccgccgctcccgcactgccccccgcggcggggcgtcctgccccattgtgaggcggcggcaggacgagaggaggtagggcgcgctcggggggcaggggcggcggcggctccgctcgctcgacacccgggcagcggcaggaacgaactcggctccggtagcggccgcggcgcgtcagtcacacaaaaggcagccgagcttctcccagcgcgcggaccggcccacgctgccgccgagggctccccaccttaccggctttcctttccctccaattttgatagggaagcggggccggcgcgggcggccgagggtccaggcgagcccgcgggcggacgggagatgccgctgctacaccgaaagccgtttgtgagacagaagccgcccgcggacctgcggcccgacgaggaagttttctactgtaaagtcaccaacgagatcttccgccactacgatgacttttttgaacgaaccattctgtgcaacagccttgtgtggagttgtgctgtgacgggtagacctggactgacgtatcaggaagcacttgagtcagaaaaaaaagcaagacagaatcttcagagttttccagaaccactaattattccagttttatacttgaccagccttacccatcgttcgcgcttacatgaaatttgtgatgatatctttgcatatgtcaaggatcgatattttgtcgaagaaactgtggaagtcattaggaacaatggtgcaaggttgcagtgtaggattttggaagtcctccctccatcacatcaaaatggttttgctaatggacatgttaacagtgtggatggagaaactattatcatcagtgatagtgatgattcagaaacacaaagctgttcttttcaaaatgggaagaaaaaagatgcaattgatcccttactattcaagtataaagtgcaacccactaaaaaagaattacatgagtctgctattgttaaagcaacacaaatcagccggagaaaacacctattttctcgtgataaactaaagctttttctgaagcaacactgtgaaccacaagatggagtcattaaaataaaggcatcatctctttcaacgtataaaatagcagaacaagatttttcttatttcttccctgatgatccacccacatttatcttcagtcctgctaacagacgaagagggagacctcccaaacgaatacatattagtcaagaggacaatgttgctaataaacagactcttgcaagttataggagcaaagctactaaagaaagagataaacttttgaaacaagaagaaatgaagtcactggcttttgaaaaggctaaattaaaaagagaaaaagcagatgccctagaagcgaagaaaaaagaaaaagaagataaagagaaaaagagggaagaattgaaaaaaattgttgaagaagagagactaaagaaaaaagaagaaaaagagaggcttaaagtagaaagagaaaaggaaagagagaagttacgtgaagaaaagcgaaagtatgtggaatacttaaaacagtggagtaaacctagagaagatatggaatgtgatgaccttaaggaacttccagaaccaacaccagtgaaaactagactacctcctgaaatctttggtgatgctctgatggttttggagttccttaatgcatttggggaactttttgatcttcaagatgagtttcctgatggagtaaccctagaagtattagaggaagctcttgtaggaaatgacagtgaaggcccactgtgtgaattgctttttttcttcctgactgcaatcttccaggcaatagctgaagaagaagaggaagtagccaaagagcaactaactgatgctgacaccaaagatttaacagaggctttggatgaagatgcagaccccacaaaatctgcactgtctgcagttgcatctttggcagctgcatggccacagttacaccagggctgcagtttgaaaagtttggatcttgatagctgcactctttcagaaatcctcagactgcacatcttagcttcaggtgctgatgtaacatcagcaaatgcaaagtatagatatcaaaaacgaggaggatttgatgctacagatgatgcttgtatggagcttcgtttgagcaatcccagtctagtgaagaaactgtcaagcacctcagtgtatgatttgacaccaggagaaaaaatgaagatactccatgctctctgtggaaagctactgaccctagtttcaactagggattttattgaagattatgttgatatattacgacaggcaaagcaggagttccgggaattaaaagcagaacaacatcgaaaagagagggaagaagcagctgccagaattcgtaaaaggaaggaagaaaaacttaaggagcaagaacaaaaaatgaaagagaaacaagaaaaactgaaagaagatgagcaaagaaattcaacggcagatatatctattggggaggaagaaagggaagattttgatactagcattgagagcaaagacacagagcaaaaggaattagatcaagatatggtcactgaagatgaagatgacccaggatcacataaaagaggcagaagggggaaaagaggacaaaatggatttaaagaatttacaaggcaagaacagatcaactgtgtaacaagagagcctcttactgctgatgaggaagaagcattaaaacaggaacaccaacgaaaagagaaagagctcttagaaaaaatccaaagtgccatagcctgtaccaatatctttcccttgggtcgcgaccgcatgtatagacgatactggattttcccttctattcctggactctttattgaagaggattattctggtcttactgaagacatgctgttgcctagaccttcatcatttcagaataatgtacagtctcaagatcctcaggtatccactaaaactggagagcctttgatgtctgaatctacctccaacattgaccaaggtccacgtgaccattctgtgcagctgccaaaaccagtgcataagccaaatcggtggtgcttttacagttcttgtgaacagctagaccagcttattgaagctcttaattctagaggacatagagaaagtgccttaaaagaaactttgttacaagagaaaagcagaatatgtgcacagctagcccgtttttctgaagagaaatttcatttttcagacaaacctcagcctgatagcaaaccaacatatagtcggggaagatcttccaatgcatatgatccatctcagatgtgtgcagaaaagcaacttgaactaaggctgagagattttcttttagatattgaagatagaatctaccaaggaacattaggagccatcaaggttacagatcgacatatctggagatcagcattagaaagtggacggtatgagctgttaagtgaggaaaacaaggaaaatgggataattaaaactgtgaatgaagacgtagaagagatggaaattgatgaacaaacaaaggtcatagtaaaagacagacttttggggataaaaacagaaactccaagtactgtatcaacaaatgcaagtacaccacaatcagtgagcagtgtggttcattatctggcaatggcactctttcaaatagagcagggcattgagcggcgttttctgaaagctccacttgatgccagtgacagtgggcgttcttataaaacagttctggaccgttggagagagtctctcctttcttctgctagtctatcccaagtttttcttcacctatccaccttggatcgtagcgtgatatggtctaaatctatactgaatgcgcgttgcaagatatgtcgaaagaaaggcgatgctgaaaacatggttctttgtgatggctgtgataggggtcatcatacctactgtgttcgaccaaagctcaagactgtgcctgaaggagactggttttgtccagaatgtcgaccaaagcaacgttctagaagactctcctctagacagagaccatccttggaaagtgatgaagatgtggaagacagtatgggaggtgaggatgatgaagttgatggcgatgaagaagaaggtcaaagtgaggaggaagagtatgaggtagaacaagatgaagatgactctcaagaagaggaagaagtcagcctacccaaacgaggaagaccacaagttagattgccagttaaaacaagagggaaacttagctcttctttctcaagtcgtggccaacaacaagaacctggaagatacccttcaaggagtcagcagagcacacccaaaacaactgtttcttctaaaactggtagaagcctaagaaagataaactctgctcctcctacagaaacaaaatctttaagaattgccagtcgttctactcgccacagtcatggcccactgcaagcagatgtatttgtggaattgcttagtcctcgtagaaaacgcagaggcaggaaaagtgctaataatacaccagaaaatagtcccaacttccctaacttcagagtcattgccacaaagtcaagtgaacagtcaagatctgtaaatattgcttcaaaactttctctccaagagagtgaatccaaaagaagatgcagaaaaagacaatctccagagccatcgcctgtgacactgggtcgaaggagttctggccgacagggaggagttcatgaattgtctgcttttgaacaacttgttgtagaattggtacgacatgatgacagctggccttttttgaaacttgtttctaaaatccaggtcccagactactatgacatcatcaaaaagcccattgccttaaatataattcgtgaaaaagtgaataagtgtgaatataaattagcatctgagtttattgatgacattgagttaatgttttcgaactgctttgaatacaaccctcgtaacacaagtgaagcaaaagctggaactaggcttcaagcattttttcatattcaggctcaaaagcttggactccacgtcacacccagtaatgtggaccaagttagcacaccaccggctgcgaaaaagtcacgaatctgactttgtccttctaaaggatatatttgaagaaaaacaaattgttcatgaaaatggaacattaaatcatgctgtataaagcaataacaattgattgaccacatgaaagtgtggcctgcactatattctcaattttaatattaagcactcaggagaatgtaggaaagatatcctttgctacagttttgttcagtatctaataagtttgatagatgtattggatacagtactggtttacagaggtttttgtacatttttgagatcattcatgtgtccagagatcttggaaaatattttttcacccacgatttattttgttattgatgatttttttttaaagtggtggtattaagggagagttatctacatggatgagtcttccgctatagcacagtttagaaaaggtgtttatgtcttaattaattgtttgagtacattctttcaacactacacatgaatgaatccaatcttataaccttgaagtgctgtaccagtgctggctgcaggtattaagtccaagtttattaactagatatttatttagtattgagagtaatttgtgaatttgttttgtatttataaaatttatacctgaaaaatgttccttaatgttttaaaccttttactgtgtttttattcctctaacttccttaatgatcaatcaaaaaaagtaacaccctccctttttcctgacagttctttcagctttacagaactgtattataagtttctatgtataactttttaactgtacaaataaaataacattttttca

SEQ ID NO: 307252 - DNA, 6807 bp, Homo sapiens
taacgcctttcacaaatgtttattttgctaggtgtatgaacagttaaagccagcctgaaagataaaaaatactaactcttgatttcgatttcttacattttctgctccaaagtacaaaggaacttaaatttgaagttataaaacggatcccacattgtttctgtaattatcatttcgcagtattggtaataggaataacatctttgtcgaataaccattcctaaaacttacttttagactcattcttacatattaatttgcaaataagcaaatgttaaggacagtatcaaaaaagactttaaaacacatctagtgaacgttctgagttacttctagtttcgaaaattctattgaattccaaggtcacatgtattatgtacattaaacttgtttccctaaataaaagttactgatatgggaaagttgctttaggggaattttcgctagtaaatccataatccttaaaattctaagtgaattaaacattgatactttgcaaatatttacagcagtgtaaatattactttttaaaggtgcgttagtttcaagaatgctggggtcctacaagcatgatgacactttgtaacacatactttttttttggtcttttcctctgctttctaaatctcttaattgccataagtattaaatagaactgatgtcaaggtatcttctgttcaagatggatgtttactaaacatgcaaagtatttttagagatatagattctaatttggaagaagaaaaatagcaacaaattttcttattcatttcttttctcatctttaaaatacaagttaaatcgtaattggaatcccttttcccatcgtgtagtcaagagtctgtgccagacttgaaggctttactttgttagccatgtgtttatgaacccccagcgctttccctagatcttttggctgataatctcaaacatggaggatgcttctgaatcttcacgaggggttgctccattaattaataatgtagttctcccaggctctccgctgtctcttcctgtatcagtgacaggctgtaaaagtcatcgagtagccaataaaaaggtagaagcgaggagtgaaaagctcctcccaacagctcttcctccttcagagccgaaagtagatcagaaacttcccaggagctccgagaggcggggaagtggcggtgggacgcaattccccgcgcggagtcgggcagtggcagcgggagaagcggcagccaggggcgcggcggggccggagagaggcggtcccctgggaggacggggtctcccctcgttgcctttgtagtggagaaggtggacaagtggcagtcggcgtgatcgcagggaagcggggccggcgcgggcggccgagggtccaggcgagcccgcgggcggaccgaaagccgtttgtgagacagaagccgcccgcggacctgcggcccgacgaggaagttttctactgtaaagtcaccaacgagatcttccgccactacgatgacttttttgaacgaaccattctgtgcaacagccttgtgtggagttgtgctgtgacgggtagacctggactgacgtatcaggaagcacttgagtcagaaaaaaaagcaagacagaatcttcagagttttccagaaccactaattattccagttttatacttgaccagccttacccatcgttcgcgcttacatgaaatttgtgatgatatctttgcatatgtcaaggatcgatattttgtcgaagaaactgtggaagtcattaggaacaatggtgcaaggttgcagtgtaggattttggaagtcctccctccatcacatcaaaatggttttgctaatggacatgttaacagtgtggatggagaaactattatcatcagtgatagtgatgattcagaaacacaaagctgttcttttcaaaatgggaagaaaaaagatgcaattgatcccttactattcaagtataaagtgcaacccactaaaaaagaattacatgagtctgctattgttaaagcaacacaaatcagccggagaaaacacctattttctcgtgataaactaaagctttttctgaagcaacactgtgaaccacaagatggagtcattaaaataaaggcatcatctctttcaacgtataaaatagcagaacaagatttttcttatttcttccctgatgatccacccacatttatcttcagtcctgctaacagacgaagagggagacctcccaaacgaatacatattagtcaagaggacaatgttgctaataaacagactcttgcaagttataggagcaaagctactaaagaaagagataaacttttgaaacaagaagaaatgaagtcactggcttttgaaaaggctaaattaaaaagagaaaaagcagatgccctagaagcgaagaaaaaagaaaaagaagataaagagaaaaagagggaagaattgaaaaaaattgttgaagaagagagactaaagaaaaaagaagaaaaagagaggcttaaagtagaaagagaaaaggaaagagagaagttacgtgaagaaaagcgaaagtatgtggaatacttaaaacagtggagtaaacctagagaagatatggaatgtgatgaccttaaggaacttccagaaccaacaccagtgaaaactagactacctcctgaaatctttggtgatgctctgatggttttggagttccttaatgcatttggggaactttttgatcttcaagatgagtttcctgatggagtaaccctagaagtattagaggaagctcttgtaggaaatgacagtgaaggcccactgtgtgaattgctttttttcttcctgactgcaatcttccaggcaatagctgaagaagaagaggaagtagccaaagagcaactaactgatgctgacaccaaagatttaacagaggctttggatgaagatgcagaccccacaaaatctgcactgtctgcagttgcatctttggcagctgcatggccacagttacaccagggctgcagtttgaaaagtttggatcttgatagctgcactctttcagaaatcctcagactgcacatcttagcttcaggtgctgatgtaacatcagcaaatgcaaagtatagatatcaaaaacgaggaggatttgatgctacagatgatgcttgtatggagcttcgtttgagcaatcccagtctagtgaagaaactgtcaagcacctcagtgtatgatttgacaccaggagaaaaaatgaagatactccatgctctctgtggaaagctactgaccctagtttcaactagggattttattgaagattatgttgatatattacgacaggcaaagcaggagttccgggaattaaaagcagaacaacatcgaaaagagagggaagaagcagctgccagaattcgtaaaaggaaggaagaaaaacttaaggagcaagaacaaaaaatgaaagagaaacaagaaaaactgaaagaagatgagcaaagaaattcaacggcagatatatctattggggaggaagaaagggaagattttgatactagcattgagagcaaagacacagagcaaaaggaattagatcaagatatggtcactgaagatgaagatgacccaggatcacataaaagaggcagaagggggaaaagaggacaaaatggatttaaagaatttacaaggcaagaacagatcaactgtgtaacaagagagcctcttactgctgatgaggaagaagcattaaaacaggaacaccaacgaaaagagaaagagctcttagaaaaaatccaaagtgccatagcctgtaccaatatctttcccttgggtcgcgaccgcatgtatagacgatactggattttcccttctattcctggactctttattgaagaggattattctggtcttactgaagacatgctgttgcctagaccttcatcatttcagaataatgtacagtctcaagatcctcaggtatccactaaaactggagagcctttgatgtctgaatctacctccaacattgaccaaggtccacgtgaccattctgtgcagctgccaaaaccagtgcataagccaaatcggtggtgcttttacagttcttgtgaacagctagaccagcttattgaagctcttaattctagaggacatagagaaagtgccttaaaagaaactttgttacaagagaaaagcagaatatgtgcacagctagcccgtttttctgaagagaaatttcatttttcagacaaacctcagcctgatagcaaaccaacatatagtcggggaagatcttccaatgcatatgatccatctcagatgtgtgcagaaaagcaacttgaactaaggctgagagattttcttttagatattgaagatagaatctaccaaggaacattaggagccatcaaggttacagatcgacatatctggagatcagcattagaaagtggacggtatgagctgttaagtgaggaaaacaaggaaaatgggataattaaaactgtgaatgaagacgtagaagagatggaaattgatgaacaaacaaaggtcatagtaaaagacagacttttggggataaaaacagaaactccaagtactgtatcaacaaatgcaagtacaccacaatcagtgagcagtgtggttcattatctggcaatggcactctttcaaatagagcagggcattgagcggcgttttctgaaagctccacttgatgccagtgacagtgggcgttcttataaaacagttctggaccgttggagagagtctctcctttcttctgctagtctatcccaagtttttcttcacctatccaccttggatcgtagcgtgatatggtctaaatctatactgaatgcgcgttgcaagatatgtcgaaagaaaggcgatgctgaaaacatggttctttgtgatggctgtgataggggtcatcatacctactgtgttcgaccaaagctcaagactgtgcctgaaggagactggttttgtccagaatgtcgaccaaagcaacgttctagaagactctcctctagacagagaccatccttggaaagtgatgaagatgtggaagacagtatgggaggtgaggatgatgaagttgatggcgatgaagaagaaggtcaaagtgaggaggaagagtatgaggtagaacaagatgaagatgactctcaagaagaggaagaagtcagcctacccaaacgaggaagaccacaagttagattgccagttaaaacaagagggaaacttagctcttctttctcaagtcgtggccaacaacaagaacctggaagatacccttcaaggagtcagcagagcacacccaaaacaactgtttcttctaaaactggtagaagcctaagaaagataaactctgctcctcctacagaaacaaaatctttaagaattgccagtcgttctactcgccacagtcatggcccactgcaagcagatgtatttgtggaattgcttagtcctcgtagaaaacgcagaggcaggaaaagtgctaataatacaccagaaaatagtcccaacttccctaacttcagagtcattgccacaaagtcaagtgaacagtcaagatctgtaaatattgcttcaaaactttctctccaagagagtgaatccaaaagaagatgcagaaaaagacaatctccagagccatcgcctgtgacactgggtcgaaggagttctggccgacagggaggagttcatgaattgtctgcttttgaacaacttgttgtagaattggtacgacatgatgacagctggccttttttgaaacttgtttctaaaatccaggtcccagactactatgacatcatcaaaaagcccattgccttaaatataattcgtgaaaaagtgaataagtgtgaatataaattagcatctgagtttattgatgacattgagttaatgttttcgaactgctttgaatacaaccctcgtaacacaagtgaagcaaaagctggaactaggcttcaagcattttttcatattcaggctcaaaagcttggactccacgtcacacccagtaatgtggaccaagttagcacaccaccggctgcgaaaaagtcacgaatctgactttgtccttctaaaggatatatttgaagaaaaacaaattgttcatgaaaatggaacattaaatcatgctgtataaagcaataacaattgattgaccacatgaaagtgtggcctgcactatattctcaattttaatattaagcactcaggagaatgtaggaaagatatcctttgctacagttttgttcagtatctaataagtttgatagatgtattggatacagtactggtttacagaggtttttgtacatttttgagatcattcatgtgtccagagatcttggaaaatattttttcacccacgatttattttgttattgatgatttttttttaaagtggtggtattaagggagagttatctacatggatgagtcttccgctatagcacagtttagaaaaggtgtttatgtcttaattaattgtttgagtacattctttcaacactacacatgaatgaatccaatcttataaccttgaagtgctgtaccagtgctggctgcaggtattaagtccaagtttattaactagatatttatttagtattgagagtaatttgtgaatttgttttgtatttataaaatttatacctgaaaaatgttccttaatgttttaaaccttttactgtgtttttattcctctaacttccttaatgatcaatcaaaaaaagtaacaccctccctttttcctgacagttctttcagctttacagaactgtattataagtttctatgtataactttttaactgtacaaataaaataacattttttca

SEQ ID NO: 307253 - DNA, 5624 bp, Homo sapiens
ttagctgcttaaagttttcagtttttcactgaaaagcagatggaactcaaagtctggttttgactgatgtacctttaaattgcaaaatataaatatttagtttaaatatactttttcttatgtttgtattaatgttataagttgaccagttaccaaacccttgagttctgtgagtctacataaaattttgcattaaaggcacaaaaataacctgataatgctatcagtttttaatgtaaaatttgtgaaatgataggtaatgggcttttgtttttgtttttgttttttaatcagtgacttttttgaacgaaccattctgtgcaacagccttgtgtggagttgtgctgtgacgggtagacctggactgacgtatcaggaagcacttgagtcagaaaaaaaagcaagacagaatcttcagagttttccagaaccactaattattccagttttatacttgaccagccttacccatcgttcgcgcttacatgaaatttgtgatgatatctttgcatatgtcaaggatcgatattttgtcgaagaaactgtggaagtcattaggaacaatggtgcaaggttgcagtgtaggattttggaagtcctccctccatcacatcaaaatggttttgctaatggacatgttaacagtgtggatggagaaactattatcatcagtgatagtgatgattcagaaacacaaagctgttcttttcaaaatgggaagaaaaaagatgcaattgatcccttactattcaagtataaagtgcaacccactaaaaaagaattacatgagtctgctattgttaaagcaacacaaatcagccggagaaaacacctattttctcgtgataaactaaagctttttctgaagcaacactgtgaaccacaagatggagtcattaaaataaaggcatcatctctttcaacgtataaaatagcagaacaagatttttcttatttcttccctgatgatccacccacatttatcttcagtcctgctaacagacgaagagggagacctcccaaacgaatacatattagtcaagaggacaatgttgctaataaacagactcttgcaagttataggagcaaagctactaaagaaagagataaacttttgaaacaagaagaaatgaagtcactggcttttgaaaaggctaaattaaaaagagaaaaagcagatgccctagaagcgaagaaaaaagaaaaagaagataaagagaaaaagagggaagaattgaaaaaaattgttgaagaagagagactaaagaaaaaagaagaaaaagagaggcttaaagtagaaagagaaaaggaaagagagaagttacgtgaagaaaagcgaaagtatgtggaatacttaaaacagtggagtaaacctagagaagatatggaatgtgatgaccttaaggaacttccagaaccaacaccagtgaaaactagactacctcctgaaatctttggtgatgctctgatggttttggagttccttaatgcatttggggaactttttgatcttcaagatgagtttcctgatggagtaaccctagaagtattagaggaagctcttgtaggaaatgacagtgaaggcccactgtgtgaattgctttttttcttcctgactgcaatcttccaggcaatagctgaagaagaagaggaagtagccaaagagcaactaactgatgctgacaccaaagatttaacagaggctttggatgaagatgcagaccccacaaaatctgcactgtctgcagttgcatctttggcagctgcatggccacagttacaccagggctgcagtttgaaaagtttggatcttgatagctgcactctttcagaaatcctcagactgcacatcttagcttcaggtgctgatgtaacatcagcaaatgcaaagtatagatatcaaaaacgaggaggatttgatgctacagatgatgcttgtatggagcttcgtttgagcaatcccagtctagtgaagaaactgtcaagcacctcagtgtatgatttgacaccaggagaaaaaatgaagatactccatgctctctgtggaaagctactgaccctagtttcaactagggattttattgaagattatgttgatatattacgacaggcaaagcaggagttccgggaattaaaagcagaacaacatcgaaaagagagggaagaagcagctgccagaattcgtaaaaggaaggaagaaaaacttaaggagcaagaacaaaaaatgaaagagaaacaagaaaaactgaaagaagatgagcaaagaaattcaacggcagatatatctattggggaggaagaaagggaagattttgatactagcattgagagcaaagacacagagcaaaaggaattagatcaagatatggtcactgaagatgaagatgacccaggatcacataaaagaggcagaagggggaaaagaggacaaaatggatttaaagaatttacaaggcaagaacagatcaactgtgtaacaagagagcctcttactgctgatgaggaagaagcattaaaacaggaacaccaacgaaaagagaaagagctcttagaaaaaatccaaagtgccatagcctgtaccaatatctttcccttgggtcgcgaccgcatgtatagacgatactggattttcccttctattcctggactctttattgaagaggattattctggtcttactgaagacatgctgttgcctagaccttcatcatttcagaataatgtacagtctcaagatcctcaggtatccactaaaactggagagcctttgatgtctgaatctacctccaacattgaccaaggtccacgtgaccattctgtgcagctgccaaaaccagtgcataagccaaatcggtggtgcttttacagttcttgtgaacagctagaccagcttattgaagctcttaattctagaggacatagagaaagtgccttaaaagaaactttgttacaagagaaaagcagaatatgtgcacagctagcccgtttttctgaagagaaatttcatttttcagacaaacctcagcctgatagcaaaccaacatatagtcggggaagatcttccaatgcatatgatccatctcagatgtgtgcagaaaagcaacttgaactaaggctgagagattttcttttagatattgaagatagaatctaccaaggaacattaggagccatcaaggttacagatcgacatatctggagatcagcattagaaagtggacggtatgagctgttaagtgaggaaaacaaggaaaatgggataattaaaactgtgaatgaagacgtagaagagatggaaattgatgaacaaacaaaggtcatagtaaaagacagacttttggggataaaaacagaaactccaagtactgtatcaacaaatgcaagtacaccacaatcagtgagcagtgtggttcattatctggcaatggcactctttcaaatagagcagggcattgagcggcgttttctgaaagctccacttgatgccagtgacagtgggcgttcttataaaacagttctggaccgttggagagagtctctcctttcttctgctagtctatcccaagtttttcttcacctatccaccttggatcgtagcgtgatatggtctaaatctatactgaatgcgcgttgcaagatatgtcgaaagaaaggcgatgctgaaaacatggttctttgtgatggctgtgataggggtcatcatacctactgtgttcgaccaaagctcaagactgtgcctgaaggagactggttttgtccagaatgtcgaccaaagcaacgttctagaagactctcctctagacagagaccatccttggaaagtgatgaagatgtggaagacagtatgggaggtgaggatgatgaagttgatggcgatgaagaagaaggtcaaagtgaggaggaagagtatgaggtagaacaagatgaagatgactctcaagaagaggaagaagtcagcctacccaaacgaggaagaccacaagttagattgccagttaaaacaagagggaaacttagctcttctttctcaagtcgtggccaacaacaagaacctggaagatacccttcaaggagtcagcagagcacacccaaaacaactgtttcttctaaaactggtagaagcctaagaaagataaactctgctcctcctacagaaacaaaatctttaagaattgccagtcgttctactcgccacagtcatggcccactgcaagcagatgtatttgtggaattgcttagtcctcgtagaaaacgcagaggcaggaaaagtgctaataatacaccagaaaatagtcccaacttccctaacttcagagtcattgccacaaagtcaagtgaacagtcaagatctgtaaatattgcttcaaaactttctctccaagagagtgaatccaaaagaagatgcagaaaaagacaatctccagagccatcgcctgtgacactgggtcgaaggagttctggccgacagggaggagttcatgaattgtctgcttttgaacaacttgttgtagaattggtacgacatgatgacagctggccttttttgaaacttgtttctaaaatccaggtcccagactactatgacatcatcaaaaagcccattgccttaaatataattcgtgaaaaagtgaataagtgtgaatataaattagcatctgagtttattgatgacattgagttaatgttttcgaactgctttgaatacaaccctcgtaacacaagtgaagcaaaagctggaactaggcttcaagcattttttcatattcaggctcaaaagcttggactccacgtcacacccagtaatgtggaccaagttagcacaccaccggctgcgaaaaagtcacgaatctgactttgtccttctaaaggatatatttgaagaaaaacaaattgttcatgaaaatggaacattaaatcatgctgtataaagcaataacaattgattgaccacatgaaagtgtggcctgcactatattctcaattttaatattaagcactcaggagaatgtaggaaagatatcctttgctacagttttgttcagtatctaataagtttgatagatgtattggatacagtactggtttacagaggtttttgtacatttttgagatcattcatgtgtccagagatcttggaaaatattttttcacccacgatttattttgttattgatgatttttttttaaagtggtggtattaagggagagttatctacatggatgagtcttccgctatagcacagtttagaaaaggtgtttatgtcttaattaattgtttgagtacattctttcaacactacacatgaatgaatccaatcttataaccttgaagtgctgtaccagtgctggctgcaggtattaagtccaagtttattaactagatatttatttagtattgagagtaatttgtgaatttgttttgtatttataaaatttatacctgaaaaatgttccttaatgttttaaaccttttactgtgtttttattcctctaacttccttaatgatcaatcaaaaaaagtaacaccctccctttttcctgacagttctttcagctttacagaactgtattataagtttctatgtataactttttaactgtacaaataaaataacattttttca

SEQ ID NO: 307254 - DNA, 4740 bp, Homo sapiens
  misc_feature (139)..(139): n is a, c, g, or t
  misc_feature (144)..(144): n is a, c, g, or t
gtaacaagagagcctcttactgctgatgaggaagaagcattaaaacaggaacaccaacgaaaagagaaagagctcttagaaaaaatccaaagtgccatagcctgtaccaatatctttcccttgggtcgcgacctcccanacgantacatattagtcaagaggacaatgttgctaataaacagactcttgcaagttataggagcaaagctactaaagaaagagataaacttttgaaacaagaagaaatgaagtcactggcttttgaaaaggctaaattaaaaagagaaaaagcagatgccctagaagcgaagaaaaaagaaaaagaagataaagagaaaaagagggaagaattgaaaaaaattgttgaagaagagagactaaagaaaaaagaagaaaaagagaggcttaaagtagaaagagaaaaggaaagagagaagttacgtgaagaaaagcgaaagtatgtggaatacttaaaacagtggagtaaacctagagaagatatggaatgtgatgaccttaaggaacttccagaaccaacaccagtgaaaactagactacctcctgaaatctttggtgatgctctgatggttttggagttccttaatgcatttggggaactttttgatcttcaagatgagtttcctgatggagtaaccctagaagtattagaggaagctcttgtaggaaatgacagtgaaggcccactgtgtgaattgctttttttcttcctgactgcaatcttccaggcaatagctgaagaagaagaggaagtagccaaagagcaactaactgatgctgacaccaaagatttaacagaggctttggatgaagatgcagaccccacaaaatctgcactgtctgcagttgcatctttggcagctgcatggccacagttacaccagggctgcagtttgaaaagtttggatcttgatagctgcactctttcagaaatcctcagactgcacatcttagcttcaggtgctgatgtaacatcagcaaatgcaaagtatagatatcaaaaacgaggaggatttgatgctacagatgatgcttgtatggagcttcgtttgagcaatcccagtctagtgaagaaactgtcaagcacctcagtgtatgatttgacaccaggagaaaaaatgaagatactccatgctctctgtggaaagctactgaccctagtttcaactagggattttattgaagattatgttgatatattacgacaggcaaagcaggagttccgggaattaaaagcagaacaacatcgaaaagagagggaagaagcagctgccagaattcgtaaaaggaaggaagaaaaacttaaggagcaagaacaaaaaatgaaagagaaacaagaaaaactgaaagaagatgagcaaagaaattcaacggcagatatatctattggggaggaagaaagggaagattttgatactagcattgagagcaaagacacagagcaaaaggaattagatcaagatatggtcactgaagatgaagatgacccaggatcacataaaagaggcagaagggggaaaagaggacaaaatggatttaaagaatttacaaggcaagaacagatcaactgtgtaacaagagagcctcttactgctgatgaggaagaagcattaaaacaggaacaccaacgaaaagagaaagagctcttagaaaaaatccaaagtgccatagcctgtaccaatatctttcccttgggtcgcgaccgcatgtatagacgatactggattttcccttctattcctggactctttattgaagaggattattctggtcttactgaagacatgctgttgcctagaccttcatcatttcagaataatgtacagtctcaagatcctcaggtatccactaaaactggagagcctttgatgtctgaatctacctccaacattgaccaaggtccacgtgaccattctgtgcagctgccaaaaccagtgcataagccaaatcggtggtgcttttacagttcttgtgaacagctagaccagcttattgaagctcttaattctagaggacatagagaaagtgccttaaaagaaactttgttacaagagaaaagcagaatatgtgcacagctagcccgtttttctgaagagaaatttcatttttcagacaaacctcagcctgatagcaaaccaacatatagtcggggaagatcttccaatgcatatgatccatctcagatgtgtgcagaaaagcaacttgaactaaggctgagagattttcttttagatattgaagatagaatctaccaaggaacattaggagccatcaaggttacagatcgacatatctggagatcagcattagaaagtggacggtatgagctgttaagtgaggaaaacaaggaaaatgggataattaaaactgtgaatgaagacgtagaagagatggaaattgatgaacaaacaaaggtcatagtaaaagacagacttttggggataaaaacagaaactccaagtactgtatcaacaaatgcaagtacaccacaatcagtgagcagtgtggttcattatctggcaatggcactctttcaaatagagcagggcattgagcggcgttttctgaaagctccacttgatgccagtgacagtgggcgttcttataaaacagttctggaccgttggagagagtctctcctttcttctgctagtctatcccaagtttttcttcacctatccaccttggatcgtagcgtgatatggtctaaatctatactgaatgcgcgttgcaagatatgtcgaaagaaaggcgatgctgaaaacatggttctttgtgatggctgtgataggggtcatcatacctactgtgttcgaccaaagctcaagactgtgcctgaaggagactggttttgtccagaatgtcgaccaaagcaacgttctagaagactctcctctagacagagaccatccttggaaagtgatgaagatgtggaagacagtatgggaggtgaggatgatgaagttgatggcgatgaagaagaaggtcaaagtgaggaggaagagtatgaggtagaacaagatgaagatgactctcaagaagaggaagaagtcagcctacccaaacgaggaagaccacaagttagattgccagttaaaacaagagggaaacttagctcttctttctcaagtcgtggccaacaacaagaacctggaagatacccttcaaggagtcagcagagcacacccaaaacaactgtttcttctaaaactggtagaagcctaagaaagataaactctgctcctcctacagaaacaaaatctttaagaattgccagtcgttctactcgccacagtcatggcccactgcaagcagatgtatttgtggaattgcttagtcctcgtagaaaacgcagaggcaggaaaagtgctaataatacaccagaaaatagtcccaacttccctaacttcagagtcattgccacaaagtcaagtgaacagtcaagatctgtaaatattgcttcaaaactttctctccaagagagtgaatccaaaagaagatgcagaaaaagacaatctccagagccatcgcctgtgacactgggtcgaaggagttctggccgacagggaggagttcatgaattgtctgcttttgaacaacttgttgtagaattggtacgacatgatgacagctggccttttttgaaacttgtttctaaaatccaggtcccagactactatgacatcatcaaaaagcccattgccttaaatataattcgtgaaaaagtgaataagtgtgaatataaattagcatctgagtttattgatgacattgagttaatgttttcgaactgctttgaatacaaccctcgtaacacaagtgaagcaaaagctggaactaggcttcaagcattttttcatattcaggctcaaaagcttggactccacgtcacacccagtaatgtggaccaagttagcacaccaccggctgcgaaaaagtcacgaatctgactttgtccttctaaaggatatatttgaagaaaaacaaattgttcatgaaaatggaacattaaatcatgctgtataaagcaataacaattgattgaccacatgaaagtgtggcctgcactatattctcaattttaatattaagcactcaggagaatgtaggaaagatatcctttgctacagttttgttcagtatctaataagtttgatagatgtattggatacagtactggtttacagaggtttttgtacatttttgagatcattcatgtgtccagagatcttggaaaatattttttcacccacgatttattttgttattgatgatttttttttaaagtggtggtattaagggagagttatctacatggatgagtcttccgctatagcacagtttagaaaaggtgtttatgtcttaattaattgtttgagtacattctttcaacactacacatgaatgaatccaatcttataaccttgaagtgctgtaccagtgctggctgcaggtattaagtccaagtttattaactagatatttatttagtattgagagtaatttgtgaatttgttttgtatttataaaatttatacctgaaaaatgttccttaatgttttaaaccttttactgtgtttttattcctctaacttccttaatgatcaatcaaaaaaagtaacaccctccctttttcctgacagttctttcagctttacagaactgtattataagtttctatgtataactttttaactgtacaaataaaataacattttttca

SEQ ID NO: 307255 - DNA, 4938 bp, Homo sapiens
aagtttgagtttccagggcttacaaactggggctattttgtttgattcacacagccttttaaaacattgcttcccaaacttgaatgtacatatgaatcacttggggatcttgtcaaaatgatgaagattctaaattagtaggtctggtgggggaatgagattctgcattttttaacaaggtgatgataaccttgctgctggtcttcagatcacactttgggtattagggctttcaaaggcacagatatgtttgtcccagtactgtagtttgtcataaacttagccaatttgcttttcctgttttaataatctgctggctccctgtaggaattttaagagtctctactaatctcatttaactttaaattatttcaaggattctgttgttacatcaaaaaaattgccaagtgttattttgtctatatatatagttctaagtttgatttttcttcacagcttttgaaaaggctaaattaaaaagagaaaaagcagatgccctagaagcgaagaaaaaagaaaaagaagataaagagaaaaagagggaagaattgaaaaaaattgttgaagaagagagactaaagaaaaaagaagaaaaagagaggcttaaagtagaaagagaaaaggaaagagagaagttacgtgaagaaaagcgaaagtatgtggaatacttaaaacagtggagtaaacctagagaagatatggaatgtgatgaccttaaggaacttccagaaccaacaccagtgaaaactagactacctcctgaaatctttggtgatgctctgatggttttggagttccttaatgcatttggggaactttttgatcttcaagatgagtttcctgatggagtaaccctagaagtattagaggaagctcttgtaggaaatgacagtgaaggcccactgtgtgaattgctttttttcttcctgactgcaatcttccaggcaatagctgaagaagaagaggaagtagccaaagagcaactaactgatgctgacaccaaagatttaacagaggctttggatgaagatgcagaccccacaaaatctgcactgtctgcagttgcatctttggcagctgcatggccacagttacaccagggctgcagtttgaaaagtttggatcttgatagctgcactctttcagaaatcctcagactgcacatcttagcttcaggtgctgatgtaacatcagcaaatgcaaagtatagatatcaaaaacgaggaggatttgatgctacagatgatgcttgtatggagcttcgtttgagcaatcccagtctagtgaagaaactgtcaagcacctcagtgtatgatttgacaccaggagaaaaaatgaagatactccatgctctctgtggaaagctactgaccctagtttcaactagggattttattgaagattatgttgatatattacgacaggcaaagcaggagttccgggaattaaaagcagaacaacatcgaaaagagagggaagaagcagctgccagaattcgtaaaaggaaggaagaaaaacttaaggagcaagaacaaaaaatgaaagagaaacaagaaaaactgaaagaagatgagcaaagaaattcaacggcagatatatctattggggaggaagaaagggaagattttgatactagcattgagagcaaagacacagagcaaaaggaattagatcaagatatggtcactgaagatgaagatgacccaggatcacataaaagaggcagaagggggaaaagaggacaaaatggatttaaagaatttacaaggcaagaacagatcaactgtgtaacaagagagcctcttactgctgatgaggaagaagcattaaaacaggaacaccaacgaaaagagaaagagctcttagaaaaaatccaaagtgccatagcctgtaccaatatctttcccttgggtcgcgaccgcatgtatagacgatactggattttcccttctattcctggactctttattgaagaggattattctggtcttactgaagacatgctgttgcctagaccttcatcatttcagaataatgtacagtctcaagatcctcaggtatccactaaaactggagagcctttgatgtctgaatctacctccaacattgaccaaggtccacgtgaccattctgtgcagctgccaaaaccagtgcataagccaaatcggtggtgcttttacagttcttgtgaacagctagaccagcttattgaagctcttaattctagaggacatagagaaagtgccttaaaagaaactttgttacaagagaaaagcagaatatgtgcacagctagcccgtttttctgaagagaaatttcatttttcagacaaacctcagcctgatagcaaaccaacatatagtcggggaagatcttccaatgcatatgatccatctcagatgtgtgcagaaaagcaacttgaactaaggctgagagattttcttttagatattgaagatagaatctaccaaggaacattaggagccatcaaggttacagatcgacatatctggagatcagcattagaaagtggacggtatgagctgttaagtgaggaaaacaaggaaaatgggataattaaaactgtgaatgaagacgtagaagagatggaaattgatgaacaaacaaaggtcatagtaaaagacagacttttggggataaaaacagaaactccaagtactgtatcaacaaatgcaagtacaccacaatcagtgagcagtgtggttcattatctggcaatggcactctttcaaatagagcagggcattgagcggcgttttctgaaagctccacttgatgccagtgacagtgggcgttcttataaaacagttctggaccgttggagagagtctctcctttcttctgctagtctatcccaagtttttcttcacctatccaccttggatcgtagcgtgatatggtctaaatctatactgaatgcgcgttgcaagatatgtcgaaagaaaggcgatgctgaaaacatggttctttgtgatggctgtgataggggtcatcatacctactgtgttcgaccaaagctcaagactgtgcctgaaggagactggttttgtccagaatgtcgaccaaagcaacgttctagaagactctcctctagacagagaccatccttggaaagtgatgaagatgtggaagacagtatgggaggtgaggatgatgaagttgatggcgatgaagaagaaggtcaaagtgaggaggaagagtatgaggtagaacaagatgaagatgactctcaagaagaggaagaagtcagcctacccaaacgaggaagaccacaagttagattgccagttaaaacaagagggaaacttagctcttctttctcaagtcgtggccaacaacaagaacctggaagatacccttcaaggagtcagcagagcacacccaaaacaactgtttcttctaaaactggtagaagcctaagaaagataaactctgctcctcctacagaaacaaaatctttaagaattgccagtcgttctactcgccacagtcatggcccactgcaagcagatgtatttgtggaattgcttagtcctcgtagaaaacgcagaggcaggaaaagtgctaataatacaccagaaaatagtcccaacttccctaacttcagagtcattgccacaaagtcaagtgaacagtcaagatctgtaaatattgcttcaaaactttctctccaagagagtgaatccaaaagaagatgcagaaaaagacaatctccagagccatcgcctgtgacactgggtcgaaggagttctggccgacagggaggagttcatgaattgtctgcttttgaacaacttgttgtagaattggtacgacatgatgacagctggccttttttgaaacttgtttctaaaatccaggtcccagactactatgacatcatcaaaaagcccattgccttaaatataattcgtgaaaaagtgaataagtgtgaatataaattagcatctgagtttattgatgacattgagttaatgttttcgaactgctttgaatacaaccctcgtaacacaagtgaagcaaaagctggaactaggcttcaagcattttttcatattcaggctcaaaagcttggactccacgtcacacccagtaatgtggaccaagttagcacaccaccggctgcgaaaaagtcacgaatctgactttgtccttctaaaggatatatttgaagaaaaacaaattgttcatgaaaatggaacattaaatcatgctgtataaagcaataacaattgattgaccacatgaaagtgtggcctgcactatattctcaattttaatattaagcactcaggagaatgtaggaaagatatcctttgctacagttttgttcagtatctaataagtttgatagatgtattggatacagtactggtttacagaggtttttgtacatttttgagatcattcatgtgtccagagatcttggaaaatattttttcacccacgatttattttgttattgatgatttttttttaaagtggtggtattaagggagagttatctacatggatgagtcttccgctatagcacagtttagaaaaggtgtttatgtcttaattaattgtttgagtacattctttcaacactacacatgaatgaatccaatcttataaccttgaagtgctgtaccagtgctggctgcaggtattaagtccaagtttattaactagatatttatttagtattgagagtaatttgtgaatttgttttgtatttataaaatttatacctgaaaaatgttccttaatgttttaaaccttttactgtgtttttattcctctaacttccttaatgatcaatcaaaaaaagtaacaccctccctttttcctgacagttctttcagctttacagaactgtattataagtttctatgtataactttttaactgtacaaataaaataacattttttca

SEQ ID NO: 307256 - DNA, 3874 bp, Homo sapiens
atattctaaatgactatttcatttttaacaactataggctgcagtttgaaaagtttggatcttgatagctgcactctttcagaaatcctcagactgcacatcttagcttcaggtgctgatgtaacatcagcaaatgcaaagtatagatatcaaaaacgaggaggatttgatgctacagatgatgcttgtatggagcttcgtttgagcaatcccagtctagtgaagaaactgtcaagcacctcagtgtatgatttgacaccaggagaaaaaatgaagatactccatgctctctgtggaaagctactgaccctagtttcaactagggattttattgaagattatgttgatatattacgacaggcaaagcaggagttccgggaattaaaagcagaacaacatcgaaaagagagggaagaagcagctgccagaattcgtaaaaggaaggaagaaaaacttaaggagcaagaacaaaaaatgaaagagaaacaagaaaaactgaaagaagatgagcaaagaaattcaacggcagatatatctattggggaggaagaaagggaagattttgatactagcattgagagcaaagacacagagcaaaaggaattagatcaagatatggtcactgaagatgaagatgacccaggatcacataaaagaggcagaagggggaaaagaggacaaaatggatttaaagaatttacaaggcaagaacagatcaactgtgtaacaagagagcctcttactgctgatgaggaagaagcattaaaacaggaacaccaacgaaaagagaaagagctcttagaaaaaatccaaagtgccatagcctgtaccaatatctttcccttgggtcgcgaccgcatgtatagacgatactggattttcccttctattcctggactctttattgaagaggattattctggtcttactgaagacatgctgttgcctagaccttcatcatttcagaataatgtacagtctcaagatcctcaggtatccactaaaactggagagcctttgatgtctgaatctacctccaacattgaccaaggtccacgtgaccattctgtgcagctgccaaaaccagtgcataagccaaatcggtggtgcttttacagttcttgtgaacagctagaccagcttattgaagctcttaattctagaggacatagagaaagtgccttaaaagaaactttgttacaagagaaaagcagaatatgtgcacagctagcccgtttttctgaagagaaatttcatttttcagacaaacctcagcctgatagcaaaccaacatatagtcggggaagatcttccaatgcatatgatccatctcagatgtgtgcagaaaagcaacttgaactaaggctgagagattttcttttagatattgaagatagaatctaccaaggaacattaggagccatcaaggttacagatcgacatatctggagatcagcattagaaagtggacggtatgagctgttaagtgaggaaaacaaggaaaatgggataattaaaactgtgaatgaagacgtagaagagatggaaattgatgaacaaacaaaggtcatagtaaaagacagacttttggggataaaaacagaaactccaagtactgtatcaacaaatgcaagtacaccacaatcagtgagcagtgtggttcattatctggcaatggcactctttcaaatagagcagggcattgagcggcgttttctgaaagctccacttgatgccagtgacagtgggcgttcttataaaacagttctggaccgttggagagagtctctcctttcttctgctagtctatcccaagtttttcttcacctatccaccttggatcgtagcgtgatatggtctaaatctatactgaatgcgcgttgcaagatatgtcgaaagaaaggcgatgctgaaaacatggttctttgtgatggctgtgataggggtcatcatacctactgtgttcgaccaaagctcaagactgtgcctgaaggagactggttttgtccagaatgtcgaccaaagcaacgttctagaagactctcctctagacagagaccatccttggaaagtgatgaagatgtggaagacagtatgggaggtgaggatgatgaagttgatggcgatgaagaagaaggtcaaagtgaggaggaagagtatgaggtagaacaagatgaagatgactctcaagaagaggaagaagtcagcctacccaaacgaggaagaccacaagttagattgccagttaaaacaagagggaaacttagctcttctttctcaagtcgtggccaacaacaagaacctggaagatacccttcaaggagtcagcagagcacacccaaaacaactgtttcttctaaaactggtagaagcctaagaaagataaactctgctcctcctacagaaacaaaatctttaagaattgccagtcgttctactcgccacagtcatggcccactgcaagcagatgtatttgtggaattgcttagtcctcgtagaaaacgcagaggcaggaaaagtgctaataatacaccagaaaatagtcccaacttccctaacttcagagtcattgccacaaagtcaagtgaacagtcaagatctgtaaatattgcttcaaaactttctctccaagagagtgaatccaaaagaagatgcagaaaaagacaatctccagagccatcgcctgtgacactgggtcgaaggagttctggccgacagggaggagttcatgaattgtctgcttttgaacaacttgttgtagaattggtacgacatgatgacagctggccttttttgaaacttgtttctaaaatccaggtcccagactactatgacatcatcaaaaagcccattgccttaaatataattcgtgaaaaagtgaataagtgtgaatataaattagcatctgagtttattgatgacattgagttaatgttttcgaactgctttgaatacaaccctcgtaacacaagtgaagcaaaagctggaactaggcttcaagcattttttcatattcaggctcaaaagcttggactccacgtcacacccagtaatgtggaccaagttagcacaccaccggctgcgaaaaagtcacgaatctgactttgtccttctaaaggatatatttgaagaaaaacaaattgttcatgaaaatggaacattaaatcatgctgtataaagcaataacaattgattgaccacatgaaagtgtggcctgcactatattctcaattttaatattaagcactcaggagaatgtaggaaagatatcctttgctacagttttgttcagtatctaataagtttgatagatgtattggatacagtactggtttacagaggtttttgtacatttttgagatcattcatgtgtccagagatcttggaaaatattttttcacccacgatttattttgttattgatgatttttttttaaagtggtggtattaagggagagttatctacatggatgagtcttccgctatagcacagtttagaaaaggtgtttatgtcttaattaattgtttgagtacattctttcaacactacacatgaatgaatccaatcttataaccttgaagtgctgtaccagtgctggctgcaggtattaagtccaagtttattaactagatatttatttagtattgagagtaatttgtgaatttgttttgtatttataaaatttatacctgaaaaatgttccttaatgttttaaaccttttactgtgtttttattcctctaacttccttaatgatcaatcaaaaaaagtaacaccctccctttttcctgacagttctttcagctttacagaactgtattataagtttctatgtataactttttaactgtacaaataaaataacattttttca

SEQ ID NO: 307257 - DNA, 5908 bp, Homo sapiens
taacgcctttcacaaatgtttattttgctaggtgtatgaacagttaaagccagcctgaaagataaaaaatactaactcttgatttcgatttcttacattttctgctccaaagtacaaaggaacttaaatttgaagttataaaacggatcccacattgtttctgtaattatcatttcgcagtattggtaataggaataacatctttgtcgaataaccattcctaaaacttacttttagactcattcttacatattaatttgcaaataagcaaatgttaaggacagtatcaaaaaagactttaaaacacatctagtgaacgttctgagttacttctagtttcgaaaattctattgaattccaaggtcacatgtattatgtacattaaacttgtttccctaaataaaagttactgatatgggaaagttgctttaggggaattttcgctagtaaatccataatccttaaaattctaagtgaattaaacattgatactttgcaaatatttacagcagtgtaaatattactttttaaaggtgcgttagtttcaagaatgctggggtcctacaagcatgatgacactttgtaacacatactttttttttggtcttttcctctgctttctaaatctcttaattgccataagtattaaatagaactgatgtcaaggtatcttctgttcaagatggatgtttactaaacatgcaaagtatttttagagatatagattctaatttggaagaagaaaaatagcaacaaattttcttattcatttcttttctcatctttaaaatacaagttaaatcgtaattggaatcccttttcccatcgtgtagtcaagagtctgtgccagacttgaaggctttactttgttagccatgtgtttatgaacccccagcgctttccctagatcttttggctgataatctcaaacatggaggatgcttctgaatcttcacgaggggttgctccattaattaataatgtagttctcccaggctctccgctgtctcttcctgtatcagtgacaggctgtaaaagtcatcgagtagccaataaaaaggtagaagcgaggagtgaaaagctcctcccaacagctcttcctccttcagagccgaaagtagatcagaaacttcccaggagctccgagaggcggggaagtggcggtgggacgcaattccccgcgcggagtcgggcagtggcagcgggagaagcggcagccaggggcgcggcggggccggagagaggcggtcccctgggaggacggggtctcccctcgttgcctttgtagtggagaaggtggacaagtggcagtcggcgtgatcgcagggaagcggggccggcgcgggcggccgagggtccaggcgagcccgcgggcggacgggagatgccgctgctacaccgaaagccgtttgtgagacagaagccgcccgcggacctgcggcccgacgaggaagttttctactgtaaagtcaccaacgagatcttccgccactacgatgacttttttgaacgaaccattctgtgcaacagccttgtgtggagttgtgctgtgacgggtagacctggactgacgtatcaggaagcacttgagtcagaaaaaaaagcaagacagaatcttcagagttttccagaaccactaattattccagttttatacttgaccagccttacccatcgttcgcgcttacatgaaatttgtgatgatatctttgcatatgtcaaggatcgatattttgtcgaagaaactgtggaagtcattaggaacaatggtgcaaggttgcagtgtaggattttggaagtcctccctccatcacatcaaaatggttttgctaatggacatgttaacagtgtggatggagaaactattatcatcagtgatagtgatgattcagaaacacaaagctgttcttttcaaaatgggaagaaaaaagatgcaattgatcccttactattcaagtataaagtgcaacccactaaaaaagaattacatgagtctgctattgttaaagcaacacaaatcagccggagaaaacacctattttctcgtgataaactaaagctttttctgaagcaacactgtgaaccacaagatggagtcattaaaataaaggcatcatctctttcaacgtataaaatagcagaacaagatttttcttatttcttccctgatgatccacccacatttatcttcagtcctgctaacagacgaagagggagacctcccaaacgaatacatattagtcaagaggacaatgttgctaataaacagactcttgcaagttataggagcaaagctactaaagaaagagataaacttttgaaacaagaagaaatgaagtcactggcttttgaaaaggctaaattaaaaagagaaaaagcagatgccctagaagcgaagaaaaaagaaaaagaagataaagagaaaaagagggaagaattgaaaaaaattgttgaagaagagagactaaagaaaaaagaagaaaaagagaggcttaaagtagaaagagaaaaggaaagagagaagttacgtgaagaaaagcgaaagtatgtggaatacttaaaacagtggagtaaacctagagaagatatggaatgtgatgaccttaaggaacttccagaaccaacaccagtgaaaactagactacctcctgaaatctttggtgatgctctgatggttttggagttccttaatgcatttggggaactttttgatcttcaagatgagtttcctgatggagtaaccctagaagtattagaggaagctcttgtaggaaatgacagtgaaggcccactgtgtgaattgctttttttcttcctgactgcaatcttccaggcaatagctgaagaagaagaggaagtagccaaagagcaactaactgatgctgacaccaaagatttaacagaggctttggatgaagatgcagaccccacaaaatctgcactgtctgcagttgcatctttggcagctgcatggccacagttacaccagggctgcagtttgaaaagtttggatcttgatagctgcactctttcagaaatcctcagactgcacatcttagcttcaggtgctgatgtaacatcagcaaatgcaaagtatagatatcaaaaacgaggaggatttgatgctacagatgatgcttgtatggagcttcgtttgagcaatcccagtctagtgaagaaactgtcaagcacctcagtgtatgatttgacaccaggagaaaaaatgaagatactccatgctctctgtggaaagctactgaccctagtttcaactagggattttattgaagattatgttgatatattacgacaggcaaagcaggagttccgggaattaaaagcagaacaacatcgaaaagagagggaagaagcagctgccagaattcgtaaaaggaaggaagaaaaacttaaggagcaagaacaaaaaatgaaagagaaacaagaaaaactgaaagaagatgagcaaagaaattcaacggcagatatatctattggggaggaagaaagggaagattttgatactagcattgagagcaaagacacagagcaaaaggaattagatcaagatatggtcactgaagatgaagatgacccaggatcacataaaagaggcagaagggggaaaagaggacaaaatggatttaaagaatttacaaggcaagaacagatcaactgtgtaacaagagagcctcttactgctgatgaggaagaagcattaaaacaggaacaccaacgaaaagagaaagagctcttagaaaaaatccaaagtgccatagcctgtaccaatatctttcccttgggtcgcgaccgcatgtatagacgatactggattttcccttctattcctggactctttattgaagaggattattctggtcttactgaagacatgctgttgcctagaccttcatcatttcagaataatgtacagtctcaagatcctcaggtatccactaaaactggagagcctttgatgtctgaatctacctccaacattgaccaaggtccacgtgaccattctgtgcagctgccaaaaccagtgcataagccaaatcggtggtgcttttacagttcttgtgaacagctagaccagcttattgaagctcttaattctagaggacatagagaaagtgccttaaaagaaactttgttacaagagaaaagcagaatatgtgcacagctagcccgtttttctgaagagaaatttcatttttcagacaaacctcagcctgatagcaaaccaacatatagtcggggaagatcttccaatgcatatgatccatctcagatgtgtgcagaaaagcaacttgaactaaggctgagagattttcttttagatattgaagatagaatctaccaaggaacattaggagccatcaaggttacagatcgacatatctggagatcagcattagaaagtggacggtatgagctgttaagtgaggaaaacaaggaaaatgggataattaaaactgtgaatgaagacgtagaagagatggaaattgatgaacaaacaaaggtcatagtaaaagacagacttttggggataaaaacagaaactccaagtactgtatcaacaaatgcaagtacaccacaatcagtgagcagtgtggttcattatctggcaatggcactctttcaaatagagcagggcattgagcggcgttttctgaaagctccacttgatgccagtgacagtgggcgttcttataaaacagttctggaccgttggagagagtctctcctttcttctgctagtctatcccaagtttttcttcacctatccaccttggatcgtagcgtgatatggtctaaatctatactgaatgcgcgttgcaagatatgtcgaaagaaaggcgatgctgaaaacatggttctttgtgatggctgtgataggggtcatcatacctactgtgttcgaccaaagctcaagactgtgcctgaaggagactggttttgtccagaatgtcgaccaaagcaacgttctagaagactctcctctagacagagaccatccttggaaagtgatgaagatgtggaagacagtatgggaggtgaggatgatgaagttgatggcgatgaagaagaaggtcaaagtgaggaggaagagtatgaggtagaacaagatgaagatgactctcaagaagaggaagaagtcagcctacccaaacgaggaagaccacaagttagattgccagttaaaacaagagggaaacttagctcttctttctcaagtcgtggccaacaacaagaacctggaagatacccttcaaggagtcagcagagcacacccaaaacaactgtttcttctaaaactggtagaagcctaagaaagataaactctgctcctcctacagaaacaaaatctttaagaattgccagtcgttctactcgccacagtcatggcccactgcaagcagatgtatttgtggaattgcttagtcctcgtagaaaacgcagaggcaggaaaagtgctaataatacaccagaaaatagtcccaacttccctaacttcagagtcattgccacaaagtcaagtgaacagtcaagatctgtaaatattgcttcaaaactttctctccaagagagtgaatccaaaagaagatgcagaaaaagacaatctccagagccatcgcctgtgacactgggtcgaaggagttctggccgacagggaggagttcatgaattgtctgcttttgaacaacttgttgtagaattggtacgacatgatgacagctggccttttttgaaacttgtttctaaaatccaggtaattactagacttgataaaatgtattcctgtatattatctgatttagtccacgtgataactttgaagtagtcaaaacacctgttactcactgtctagttttttttgttgttgttgttttttcctgagacagtctca

SEQ ID NO: 307258 - DNA, 5583 bp, Homo sapiens
taacgcctttcacaaatgtttattttgctaggtgtatgaacagttaaagccagcctgaaagataaaaaatactaactcttgatttcgatttcttacattttctgctccaaagtacaaaggaacttaaatttgaagttataaaacggatcccacattgtttctgtaattatcatttcgcagtattggtaataggaataacatctttgtcgaataaccattcctaaaacttacttttagactcattcttacatattaatttgcaaataagcaaatgttaaggacagtatcaaaaaagactttaaaacacatctagtgaacgttctgagttacttctagtttcgaaaattctattgaattccaaggtcacatgtattatgtacattaaacttgtttccctaaataaaagttactgatatgggaaagttgctttaggggaattttcgctagtaaatccataatccttaaaattctaagtgaattaaacattgatactttgcaaatatttacagcagtgtaaatattactttttaaaggtgcgttagtttcaagaatgctggggtcctacaagcatgatgacactttgtaacacatactttttttttggtcttttcctctgctttctaaatctcttaattgccataagtattaaatagaactgatgtcaaggtatcttctgttcaagatggatgtttactaaacatgcaaagtatttttagagatatagattctaatttggaagaagaaaaatagcaacaaattttcttattcatttcttttctcatctttaaaatacaagttaaatcgtaattggaatcccttttcccatcgtgtagtcaagagtctgtgccagacttgaaggctttactttgttagccatgtgtttatgaacccccagcgctttccctagatcttttggctgataatctcaaacatggaggatgcttctgaatcttcacgaggggttgctccattaattaataatgtagttctcccaggctctccgctgtctcttcctgtatcagtgacaggctgtaaaagtcatcgagtagccaataaaaaggtagaagcgaggagtgaaaagctcctcccaacagctcttcctccttcagagccgaaagtagatcagaaacttcccaggagctccgagaggcggggaagtggcggtgggacgcaattccccgcgcggagtcgggcagtggcagcgggagaagcggcagccaggggcgcggcggggccggagagaggcggtcccctgggaggacggggtctcccctcgttgcctttgtagtggagaaggtggacaagtggcagtcggcgtgatcgcagggaagcggggccggcgcgggcggccgagggtccaggcgagcccgcgggcggacgggagatgccgctgctacaccgaaagccgtttgtgagacagaagccgcccgcggacctgcggcccgacgaggaagttttctactgtaaagtcaccaacgagatcttccgccactacgatgacttttttgaacgaaccattctgtgcaacagccttgtgtggagttgtgctgtgacgggtagacctggactgacgtatcaggaagcacttgagtcagaaaaaaaagcaagacagaatcttcagagttttccagaaccactaattattccagttttatacttgaccagccttacccatcgttcgcgcttacatgaaatttgtgatgatatctttgcatatgtcaaggatcgatattttgtcgaagaaactgtggaagtcattaggaacaatggtgcaaggttgcagtgtaggattttggaagtcctccctccatcacatcaaaatggttttgctaatggacatgttaacagtgtggatggagaaactattatcatcagtgatagtgatgattcagaaacacaaagctgttcttttcaaaatgggaagaaaaaagatgcaattgatcccttactattcaagtataaagtgcaacccactaaaaaagaattacatgagtctgctattgttaaagcaacacaaatcagccggagaaaacacctattttctcgtgataaactaaagctttttctgaagcaacactgtgaaccacaagatggagtcattaaaataaaggcatcatctctttcaacgtataaaatagcagaacaagatttttcttatttcttccctgatgatccacccacatttatcttcagtcctgctaacagacgaagagggagacctcccaaacgaatacatattagtcaagaggacaatgttgctaataaacagactcttgcaagttataggagcaaagctactaaagaaagagataaacttttgaaacaagaagaaatgaagtcactggcttttgaaaaggctaaattaaaaagagaaaaagcagatgccctagaagcgaagaaaaaagaaaaagaagataaagagaaaaagagggaagaattgaaaaaaattgttgaagaagagagactaaagaaaaaagaagaaaaagagaggcttaaagtagaaagagaaaaggaaagagagaagttacgtgaagaaaagcgaaagtatgtggaatacttaaaacagtggagtaaacctagagaagatatggaatgtgatgaccttaaggaacttccagaaccaacaccagtgaaaactagactacctcctgaaatctttggtgatgctctgatggttttggagttccttaatgcatttggggaactttttgatcttcaagatgagtttcctgatggagtaaccctagaagtattagaggaagctcttgtaggaaatgacagtgaaggcccactgtgtgaattgctttttttcttcctgactgcaatcttccaggcaatagctgaagaagaagaggaagtagccaaagagcaactaactgatgctgacaccaaagatttaacagaggctttggatgaagatgcagaccccacaaaatctgcactgtctgcagttgcatctttggcagctgcatggccacagttacaccagggctgcagtttgaaaagtttggatcttgatagctgcactctttcagaaatcctcagactgcacatcttagcttcaggtgctgatgtaacatcagcaaatgcaaagtatagatatcaaaaacgaggaggatttgatgctacagatgatgcttgtatggagcttcgtttgagcaatcccagtctagtgaagaaactgtcaagcacctcagtgtatgatttgacaccaggagaaaaaatgaagatactccatgctctctgtggaaagctactgaccctagtttcaactagggattttattgaagattatgttgatatattacgacaggcaaagcaggagttccgggaattaaaagcagaacaacatcgaaaagagagggaagaagcagctgccagaattcgtaaaaggaaggaagaaaaacttaaggagcaagaacaaaaaatgaaagagaaacaagaaaaactgaaagaagatgagcaaagaaattcaacggcagatatatctattggggaggaagaaagggaagattttgatactagcattgagagcaaagacacagagcaaaaggaattagatcaagatatggtcactgaagatgaagatgacccaggatcacataaaagaggcagaagggggaaaagaggacaaaatggatttaaagaatttacaaggcaagaacagatcaactgtgtaacaagagagcctcttactgctgatgaggaagaagcattaaaacaggaacaccaacgaaaagagaaagagctcttagaaaaaatccaaagtgccatagcctgtaccaatatctttcccttgggtcgcgaccgcatgtatagacgatactggattttcccttctattcctggactctttattgaagaggattattctggtcttactgaagacatgctgttgcctagaccttcatcatttcagaataatgtacagtctcaagatcctcaggtatccactaaaactggagagcctttgatgtctgaatctacctccaacattgaccaaggtccacgtgaccattctgtgcagctgccaaaaccagtgcataagccaaatcggtggtgcttttacagttcttgtgaacagctagaccagcttattgaagctcttaattctagaggacatagagaaagtgccttaaaagaaactttgttacaagagaaaagcagaatatgtgcacagctagcccgtttttctgaagagaaatttcatttttcagacaaacctcagcctgatagcaaaccaacatatagtcggggaagatcttccaatgcatatgatccatctcagatgtgtgcagaaaagcaacttgaactaaggctgagagattttcttttagatattgaagatagaatctaccaaggaacattaggagccatcaaggttacagatcgacatatctggagatcagcattagaaagtggacggtatgagctgttaagtgaggaaaacaaggaaaatgggataattaaaactgtgaatgaagacgtagaagagatggaaattgatgaacaaacaaaggtcatagtaaaagacagacttttggggataaaaacagaaactccaagtactgtatcaacaaatgcaagtacaccacaatcagtgagcagtgtggttcattatctggcaatggcactctttcaaatagagcagggcattgagcggcgttttctgaaagctccacttgatgccagtgacagtgggcgttcttataaaacagttctggaccgttggagagagtctctcctttcttctgctagtctatcccaagtttttcttcacctatccaccttggatcgtagcgtgatatggtctaaatctatactgaatgcgcgttgcaagatatgtcgaaagaaaggcgatgctgaaaacatggttctttgtgatggctgtgataggggtcatcatacctactgtgttcgaccaaagctcaagactgtgcctgaaggagactggttttgtccagaatgtcgaccaaagcaacgttctagaagactctcctctagacagagaccatccttggaaagtgatgaagatgtggaagacagtatgggaggtgaggatgatgaagttgatggcgatgaagaagaaggtcaaagtgaggaggaagagtatgaggtagaacaagatgaagatgactctcaagaagaggaagaagtcagcctacccaaacgaggaagaccacaagttagattgccagttaaaacaagagggaaacttagctcttctttctcaagtcgtggccaacaacaagaacctggaagatacccttcaaggagtcagcagagcacacccaaaacaactgtttcttctaaaactggtagaagcctaagaaagataaactctgctcctcctacagaaacaaaatctttaagaattgccagtcgttctactcgccacagtcatggcccactgcaagcagatgtatttgtggaattgcttagtcctcgtagaaaacgcagaggcaggaaaagtgctaataatacaccagaaaatagtcccaacttccctaacttcaatgccatccccatcaagctaccaatagactttcttcacagaactggaaaaactactaaagtcatatt

SEQ ID NO: 307259 - DNA, 2587 bp, Homo sapiens
atctgcttccatcagccagattcaccacattccccttccaccatatggagaagtggcatttgaattgggttaaaggacagcaggtttggagttgggcagctgggcaatggaaataccgatcctgatgggacgaagactctggttacagatcgacatatctggagatcagcattagaaagtggacggtatgagctgttaagtgaggaaaacaaggaaaatgggataattaaaactgtgaatgaagacgtagaagagatggaaattgatgaacaaacaaaggtcatagtaaaagacagacttttggggataaaaacagaaactccaagtactgtatcaacaaatgcaagtacaccacaatcagtgagcagtgtggttcattatctggcaatggcactctttcaaatagagcagggcattgagcggcgttttctgaaagctccacttgatgccagtgacagtgggcgttcttataaaacagttctggaccgttggagagagtctctcctttcttctgctagtctatcccaagtttttcttcacctatccaccttggatcgtagcgtgatatggtctaaatctatactgaatgcgcgttgcaagatatgtcgaaagaaaggcgatgctgaaaacatggttctttgtgatggctgtgataggggtcatcatacctactgtgttcgaccaaagctcaagactgtgcctgaaggagactggttttgtccagaatgtcgaccaaagcaacgttctagaagactctcctctagacagagaccatccttggaaagtgatgaagatgtggaagacagtatgggaggtgaggatgatgaagttgatggcgatgaagaagaaggtcaaagtgaggaggaagagtatgaggtagaacaagatgaagatgactctcaagaagaggaagaagtcagcctacccaaacgaggaagaccacaagttagattgccagttaaaacaagagggaaacttagctcttctttctcaagtcgtggccaacaacaagaacctggaagatacccttcaaggagtcagcagagcacacccaaaacaactgtttcttctaaaactggtagaagcctaagaaagataaactctgctcctcctacagaaacaaaatctttaagaattgccagtcgttctactcgccacagtcatggcccactgcaagcagatgtatttgtggaattgcttagtcctcgtagaaaacgcagaggcaggaaaagtgctaataatacaccagaaaatagtcccaacttccctaacttcagagtcattgccacaaagtcaagtgaacagtcaagatctgtaaatattgcttcaaaactttctctccaagagagtgaatccaaaagaagatgcagaaaaagacaatctccagagccatcgcctgtgacactgggtcgaaggagttctggccgacagggaggagttcatgaattgtctgcttttgaacaacttgttgtagaattggtacgacatgatgacagctggccttttttgaaacttgtttctaaaatccaggtcccagactactatgacatcatcaaaaagcccattgccttaaatataattcgtgaaaaagtgaataagtgtgaatataaattagcatctgagtttattgatgacattgagttaatgttttcgaactgctttgaatacaaccctcgtaacacaagtgaagcaaaagctggaactaggcttcaagcattttttcatattcaggctcaaaagcttggactccacgtcacacccagtaatgtggaccaagttagcacaccaccggctgcgaaaaagtcacgaatctgactttgtccttctaaaggatatatttgaagaaaaacaaattgttcatgaaaatggaacattaaatcatgctgtataaagcaataacaattgattgaccacatgaaagtgtggcctgcactatattctcaattttaatattaagcactcaggagaatgtaggaaagatatcctttgctacagttttgttcagtatctaataagtttgatagatgtattggatacagtactggtttacagaggtttttgtacatttttgagatcattcatgtgtccagagatcttggaaaatattttttcacccacgatttattttgttattgatgatttttttttaaagtggtggtattaagggagagttatctacatggatgagtcttccgctatagcacagtttagaaaaggtgtttatgtcttaattaattgtttgagtacattctttcaacactacacatgaatgaatccaatcttataaccttgaagtgctgtaccagtgctggctgcaggtattaagtccaagtttattaactagatatttatttagtattgagagtaatttgtgaatttgttttgtatttataaaatttatacctgaaaaatgttccttaatgttttaaaccttttactgtgtttttattcctctaacttccttaatgatcaatcaaaaaaagtaacaccctccctttttcctgacagttctttcagctttacagaactgtattataagtttctatgtataactttttaactgtacaaataaaataacattttttca

SEQ ID NO: 307260 - DNA, 5204 bp, Homo sapiens
taacgcctttcacaaatgtttattttgctaggtgtatgaacagttaaagccagcctgaaagataaaaaatactaactcttgatttcgatttcttacattttctgctccaaagtacaaaggaacttaaatttgaagttataaaacggatcccacattgtttctgtaattatcatttcgcagtattggtaataggaataacatctttgtcgaataaccattcctaaaacttacttttagactcattcttacatattaatttgcaaataagcaaatgttaaggacagtatcaaaaaagactttaaaacacatctagtgaacgttctgagttacttctagtttcgaaaattctattgaattccaaggtcacatgtattatgtacattaaacttgtttccctaaataaaagttactgatatgggaaagttgctttaggggaattttcgctagtaaatccataatccttaaaattctaagtgaattaaacattgatactttgcaaatatttacagcagtgtaaatattactttttaaaggtgcgttagtttcaagaatgctggggtcctacaagcatgatgacactttgtaacacatactttttttttggtcttttcctctgctttctaaatctcttaattgccataagtattaaatagaactgatgtcaaggtatcttctgttcaagatggatgtttactaaacatgcaaagtatttttagagatatagattctaatttggaagaagaaaaatagcaacaaattttcttattcatttcttttctcatctttaaaatacaagttaaatcgtaattggaatcccttttcccatcgtgtagtcaagagtctgtgccagacttgaaggctttactttgttagccatgtgtttatgaacccccagcgctttccctagatcttttggctgataatctcaaacatggaggatgcttctgaatcttcacgaggggttgctccattaattaataatgtagttctcccaggctctccgctgtctcttcctgtatcagtgacaggctgtaaaagtcatcgagtagccaataaaaaggtagaagcgaggagtgaaaagctcctcccaacagctcttcctccttcagagccgaaagtagatcagaaacttcccaggagctccgagaggcggggaagtggcggtgggacgcaattccccgcgcggagtcgggcagtggcagcgggagaagcggcagccaggggcgcggcggggccggagagaggcggtcccctgggaggacggggtctcccctcgttgcctttgtagtggagaaggtggacaagtggcagtcggcgtgatcgcagggaagcggggccggcgcgggcggccgagggtccaggcgagcccgcgggcggacgggagatgccgctgctacaccgaaagccgtttgtgagacagaagccgcccgcggacctgcggcccgacgaggaagttttctactgtaaagtcaccaacgagatcttccgccactacgatgacttttttgaacgaaccattctgtgcaacagccttgtgtggagttgtgctgtgacgggtagacctggactgacgtatcaggaagcacttgagtcagaaaaaaaagcaagacagaatcttcagagttttccagaaccactaattattccagttttatacttgaccagccttacccatcgttcgcgcttacatgaaatttgtgatgatatctttgcatatgtcaaggatcgatattttgtcgaagaaactgtggaagtcattaggaacaatggtgcaaggttgcagtgtaggattttggaagtcctccctccatcacatcaaaatggttttgctaatggacatgttaacagtgtggatggagaaactattatcatcagtgatagtgatgattcagaaacacaaagctgttcttttcaaaatgggaagaaaaaagatgcaattgatcccttactattcaagtataaagtgcaacccactaaaaaagaattacatgagtctgctattgttaaagcaacacaaatcagccggagaaaacacctattttctcgtgataaactaaagctttttctgaagcaacactgtgaaccacaagatggagtcattaaaataaaggcatcatctctttcaacgtataaaatagcagaacaagatttttcttatttcttccctgatgatccacccacatttatcttcagtcctgctaacagacgaagagggagacctcccaaacgaatacatattagtcaagaggacaatgttgctaataaacagactcttgcaagttataggagcaaagctactaaagaaagagataaacttttgaaacaagaagaaatgaagtcactggcttttgaaaaggctaaattaaaaagagaaaaagcagatgccctagaagcgaagaaaaaagaaaaagaagataaagagaaaaagagggaagaattgaaaaaaattgttgaagaagagagactaaagaaaaaagaagaaaaagagaggcttaaagtagaaagagaaaaggaaagagagaagttacgtgaagaaaagcgaaagtatgtggaatacttaaaacagtggagtaaacctagagaagatatggaatgtgatgaccttaaggaacttccagaaccaacaccagtgaaaactagactacctcctgaaatctttggtgatgctctgatggttttggagttccttaatgcatttggggaactttttgatcttcaagatgagtttcctgatggagtaaccctagaagtattagaggaagctcttgtaggaaatgacagtgaaggcccactgtgtgaattgctttttttcttcctgactgcaatcttccaggcaatagctgaagaagaagaggaagtagccaaagagcaactaactgatgctgacaccaaagatttaacagaggctttggatgaagatgcagaccccacaaaatctgcactgtctgcagttgcatctttggcagctgcatggccacagttacaccagggctgcagtttgaaaagtttggatcttgatagctgcactctttcagaaatcctcagactgcacatcttagcttcaggtgctgatgtaacatcagcaaatgcaaagtatagatatcaaaaacgaggaggatttgatgctacagatgatgcttgtatggagcttcgtttgagcaatcccagtctagtgaagaaactgtcaagcacctcagtgtatgatttgacaccaggagaaaaaatgaagatactccatgctctctgtggaaagctactgaccctagtttcaactagggattttattgaagattatgttgatatattacgacaggcaaagcaggagttccgggaattaaaagcagaacaacatcgaaaagagagggaagaagcagctgccagaattcgtaaaaggaaggaagaaaaacttaaggagcaagaacaaaaaatgaaagagaaacaagaaaaactgaaagaagatgagcaaagaaattcaacggcagatatatctattggggaggaagaaagggaagattttgatactagcattgagagcaaagacacagagcaaaaggaattagatcaagatatggtcactgaagatgaagatgacccaggatcacataaaagaggcagaagggggaaaagaggacaaaatggatttaaagaatttacaaggcaagaacagatcaactgtgtaacaagagagcctcttactgctgatgaggaagaagcattaaaacaggaacaccaacgaaaagagaaagagctcttagaaaaaatccaaagtgccatagcctgtaccaatatctttcccttgggtcgcgaccgcatgtatagacgatactggattttcccttctattcctggactctttattgaagaggattattctggtcttactgaagacatgctgttgcctagaccttcatcatttcagaataatgtacagtctcaagatcctcaggtatccactaaaactggagagcctttgatgtctgaatctacctccaacattgaccaaggtccacgtgaccattctgtgcagctgccaaaaccagtgcataagccaaatcggtggtgcttttacagttcttgtgaacagctagaccagcttattgaagctcttaattctagaggacatagagaaagtgccttaaaagaaactttgttacaagagaaaagcagaatatgtgcacagctagcccgtttttctgaagagaaatttcatttttcagacaaacctcagcctgatagcaaaccaacatatagtcggggaagatcttccaatgcatatgatccatctcagatgtgtgcagaaaagcaacttgaactaaggctgagagattttcttttagatattgaagatagaatctaccaaggaacattaggagccatcaaggttacagatcgacatatctggagatcagcattagaaagtggacggtatgagctgttaagtgaggaaaacaaggaaaatgggataattaaaactgtgaatgaagacgtagaagagatggaaattgatgaacaaacaaaggtcatagtaaaagacagacttttggggataaaaacagaaactccaagtactgtatcaacaaatgcaagtacaccacaatcagtgagcagtgtggttcattatctggcaatggcactctttcaaatagagcagggcattgagcggcgttttctgaaagctccacttgatgccagtgacagtgggcgttcttataaaacagttctggaccgttggagagagtctctcctttcttctgctagtctatcccaagtttttcttcacctatccaccttggatcgtagcgtgatatggtctaaatctatactgaatgcgcgttgcaagatatgtcgaaagaaaggcgatgctgaaaacatggttctttgtgatggctgtgataggggtcatcatacctactgtgttcgaccaaagctcaagactgtgcctgaaggagactggttttggatgtttcccaggtggagaatacccgccactatctgcaacaccagcgtttgctcttctgcagagatcccaatcacattcatggcgtgcagagtttcctgaaactcccgcctgtcgtcaatgtcatcaaccttgtatgagcccgagaggctcaggtagtaataatagtccatgctggtgatgccaaggctgtgtttctgctctgcagaggcgccctcgataagctggtcaaatatgtgaaaatccg

SEQ ID NO: 307261 - DNA, 5021 bp, Homo sapiens
taacgcctttcacaaatgtttattttgctaggtgtatgaacagttaaagccagcctgaaagataaaaaatactaactcttgatttcgatttcttacattttctgctccaaagtacaaaggaacttaaatttgaagttataaaacggatcccacattgtttctgtaattatcatttcgcagtattggtaataggaataacatctttgtcgaataaccattcctaaaacttacttttagactcattcttacatattaatttgcaaataagcaaatgttaaggacagtatcaaaaaagactttaaaacacatctagtgaacgttctgagttacttctagtttcgaaaattctattgaattccaaggtcacatgtattatgtacattaaacttgtttccctaaataaaagttactgatatgggaaagttgctttaggggaattttcgctagtaaatccataatccttaaaattctaagtgaattaaacattgatactttgcaaatatttacagcagtgtaaatattactttttaaaggtgcgttagtttcaagaatgctggggtcctacaagcatgatgacactttgtaacacatactttttttttggtcttttcctctgctttctaaatctcttaattgccataagtattaaatagaactgatgtcaaggtatcttctgttcaagatggatgtttactaaacatgcaaagtatttttagagatatagattctaatttggaagaagaaaaatagcaacaaattttcttattcatttcttttctcatctttaaaatacaagttaaatcgtaattggaatcccttttcccatcgtgtagtcaagagtctgtgccagacttgaaggctttactttgttagccatgtgtttatgaacccccagcgctttccctagatcttttggctgataatctcaaacatggaggatgcttctgaatcttcacgaggggttgctccattaattaataatgtagttctcccaggctctccgctgtctcttcctgtatcagtgacaggctgtaaaagtcatcgagtagccaataaaaaggtagaagcgaggagtgaaaagctcctcccaacagctcttcctccttcagagccgaaagtagatcagaaacttcccaggagctccgagaggcggggaagtggcggtgggacgcaattccccgcgcggagtcgggcagtggcagcgggagaagcggcagccaggggcgcggcggggccggagagaggcggtcccctgggaggacggggtctcccctcgttgcctttgtagtggagaaggtggacaagtggcagtcggcgtgatcgcagggaagcggggccggcgcgggcggccgagggtccaggcgagcccgcgggcggacgggagatgccgctgctacaccgaaagccgtttgtgagacagaagccgcccgcggacctgcggcccgacgaggaagttttctactgtaaagtcaccaacgagatcttccgccactacgatgacttttttgaacgaaccattctgtgcaacagccttgtgtggagttgtgctgtgacgggtagacctggactgacgtatcaggaagcacttgagtcagaaaaaaaagcaagacagaatcttcagagttttccagaaccactaattattccagttttatacttgaccagccttacccatcgttcgcgcttacatgaaatttgtgatgatatctttgcatatgtcaaggatcgatattttgtcgaagaaactgtggaagtcattaggaacaatggtgcaaggttgcagtgtaggattttggaagtcctccctccatcacatcaaaatggttttgctaatggacatgttaacagtgtggatggagaaactattatcatcagtgatagtgatgattcagaaacacaaagctgttcttttcaaaatgggaagaaaaaagatgcaattgatcccttactattcaagtataaagtgcaacccactaaaaaagaattacatgagtctgctattgttaaagcaacacaaatcagccggagaaaacacctattttctcgtgataaactaaagctttttctgaagcaacactgtgaaccacaagatggagtcattaaaataaaggcatcatctctttcaacgtataaaatagcagaacaagatttttcttatttcttccctgatgatccacccacatttatcttcagtcctgctaacagacgaagagggagacctcccaaacgaatacatattagtcaagaggacaatgttgctaataaacagactcttgcaagttataggagcaaagctactaaagaaagagataaacttttgaaacaagaagaaatgaagtcactggcttttgaaaaggctaaattaaaaagagaaaaagcagatgccctagaagcgaagaaaaaagaaaaagaagataaagagaaaaagagggaagaattgaaaaaaattgttgaagaagagagactaaagaaaaaagaagaaaaagagaggcttaaagtagaaagagaaaaggaaagagagaagttacgtgaagaaaagcgaaagtatgtggaatacttaaaacagtggagtaaacctagagaagatatggaatgtgatgaccttaaggaacttccagaaccaacaccagtgaaaactagactacctcctgaaatctttggtgatgctctgatggttttggagttccttaatgcatttggggaactttttgatcttcaagatgagtttcctgatggagtaaccctagaagtattagaggaagctcttgtaggaaatgacagtgaaggcccactgtgtgaattgctttttttcttcctgactgcaatcttccaggcaatagctgaagaagaagaggaagtagccaaagagcaactaactgatgctgacaccaaagatttaacagaggctttggatgaagatgcagaccccacaaaatctgcactgtctgcagttgcatctttggcagctgcatggccacagttacaccagggctgcagtttgaaaagtttggatcttgatagctgcactctttcagaaatcctcagactgcacatcttagcttcaggtgctgatgtaacatcagcaaatgcaaagtatagatatcaaaaacgaggaggatttgatgctacagatgatgcttgtatggagcttcgtttgagcaatcccagtctagtgaagaaactgtcaagcacctcagtgtatgatttgacaccaggagaaaaaatgaagatactccatgctctctgtggaaagctactgaccctagtttcaactagggattttattgaagattatgttgatatattacgacaggcaaagcaggagttccgggaattaaaagcagaacaacatcgaaaagagagggaagaagcagctgccagaattcgtaaaaggaaggaagaaaaacttaaggagcaagaacaaaaaatgaaagagaaacaagaaaaactgaaagaagatgagcaaagaaattcaacggcagatatatctattggggaggaagaaagggaagattttgatactagcattgagagcaaagacacagagcaaaaggaattagatcaagatatggtcactgaagatgaagatgacccaggatcacataaaagaggcagaagggggaaaagaggacaaaatggatttaaagaatttacaaggcaagaacagatcaactgtgtaacaagagagcctcttactgctgatgaggaagaagcattaaaacaggaacaccaacgaaaagagaaagagctcttagaaaaaatccaaagtgccatagcctgtaccaatatctttcccttgggtcgcgaccgcatgtatagacgatactggattttcccttctattcctggactctttattgaagaggattattctggtcttactgaagacatgctgttgcctagaccttcatcatttcagaataatgtacagtctcaagatcctcaggtatccactaaaactggagagcctttgatgtctgaatctacctccaacattgaccaaggtccacgtgaccattctgtgcagctgccaaaaccagtgcataagccaaatcggtggtgcttttacagttcttgtgaacagctagaccagcttattgaagctcttaattctagaggacatagagaaagtgccttaaaagaaactttgttacaagagaaaagcagaatatgtgcacagctagcccgtttttctgaagagaaatttcatttttcagacaaacctcagcctgatagcaaaccaacatatagtcggggaagatcttccaatgcatatgatccatctcagatgtgtgcagaaaagcaacttgaactaaggctgagagattttcttttagatattgaagatagaatctaccaaggaacattaggagccatcaaggttacagatcgacatatctggagatcagcattagaaagtggacggtatgagctgttaagtgaggaaaacaaggaaaatgggataattaaaactgtgaatgaagacgtagaagagatggaaattgatgaacaaacaaaggtcatagtaaaagacagacttttggggataaaaacagaaactccaagtactgtatcaacaaatgcaagtacaccacaatcagtgagcagtgtggttcattatctggcaatggcactctttcaaatagagcagggcattgagcggcgttttctgaaagctccacttggtaagtatctgtttttatttcaaaatattagttgtgttataagtaattttgagttggcctttaactaatagaactttattggctgacataatgaaattgataatcttaaaaacttgagatgttttcatttttaaatgagttcttttaaggtgagatttatttttagaataatacagtcttttgtgaagagtttcatcaaaagaaagattaccagctaggcacagtggctcatgcctgtaatcccaacactttgggaggctgaggtggaatcgcttgagcccaagagtttgagaccagcctgggcaacatatagcaagaaccccatctctacaaaat

SEQ ID NO: 307262 - DNA, 3819 bp, Homo sapiens
taacgcctttcacaaatgtttattttgctaggtgtatgaacagttaaagccagcctgaaagataaaaaatactaactcttgatttcgatttcttacattttctgctccaaagtacaaaggaacttaaatttgaagttataaaacggatcccacattgtttctgtaattatcatttcgcagtattggtaataggaataacatctttgtcgaataaccattcctaaaacttacttttagactcattcttacatattaatttgcaaataagcaaatgttaaggacagtatcaaaaaagactttaaaacacatctagtgaacgttctgagttacttctagtttcgaaaattctattgaattccaaggtcacatgtattatgtacattaaacttgtttccctaaataaaagttactgatatgggaaagttgctttaggggaattttcgctagtaaatccataatccttaaaattctaagtgaattaaacattgatactttgcaaatatttacagcagtgtaaatattactttttaaaggtgcgttagtttcaagaatgctggggtcctacaagcatgatgacactttgtaacacatactttttttttggtcttttcctctgctttctaaatctcttaattgccataagtattaaatagaactgatgtcaaggtatcttctgttcaagatggatgtttactaaacatgcaaagtatttttagagatatagattctaatttggaagaagaaaaatagcaacaaattttcttattcatttcttttctcatctttaaaatacaagttaaatcgtaattggaatcccttttcccatcgtgtagtcaagagtctgtgccagacttgaaggctttactttgttagccatgtgtttatgaacccccagcgctttccctagatcttttggctgataatctcaaacatggaggatgcttctgaatcttcacgaggggttgctccattaattaataatgtagttctcccaggctctccgctgtctcttcctgtatcagtgacaggctgtaaaagtcatcgagtagccaataaaaaggtagaagcgaggagtgaaaagctcctcccaacagctcttcctccttcagagccgaaagtagatcagaaacttcccaggagctccgagaggcggggaagtggcggtgggacgcaattccccgcgcggagtcgggcagtggcagcgggagaagcggcagccaggggcgcggcggggccggagagaggcggtcccctgggaggacggggtctcccctcgttgcctttgtagtggagaaggtggacaagtggcagtcggcgtgatcgcagggaagcggggccggcgcgggcggccgagggtccaggcgagcccgcgggcggacgggagatgccgctgctacaccgaaagccgtttgtgagacagaagccgcccgcggacctgcggcccgacgaggaagttttctactgtaaagtcaccaacgagatcttccgccactacgatgacttttttgaacgaaccattctgtgcaacagccttgtgtggagttgtgctgtgacgggtagacctggactgacgtatcaggaagcacttgagtcagaaaaaaaagcaagacagaatcttcagagttttccagaaccactaattattccagttttatacttgaccagccttacccatcgttcgcgcttacatgaaatttgtgatgatatctttgcatatgtcaaggatcgatattttgtcgaagaaactgtggaagtcattaggaacaatggtgcaaggttgcagtgtaggattttggaagtcctccctccatcacatcaaaatggttttgctaatggacatgttaacagtgtggatggagaaactattatcatcagtgatagtgatgattcagaaacacaaagctgttcttttcaaaatgggaagaaaaaagatgcaattgatcccttactattcaagtataaagtgcaacccactaaaaaagaattacatgagtctgctattgttaaagcaacacaaatcagccggagaaaacacctattttctcgtgataaactaaagctttttctgaagcaacactgtgaaccacaagatggagtcattaaaataaaggcatcatctctttcaacgtataaaatagcagaacaagatttttcttatttcttccctgatgatccacccacatttatcttcagtcctgctaacagacgaagagggagacctcccaaacgaatacatattagtcaagaggacaatgttgctaataaacagactcttgcaagttataggagcaaagctactaaagaaagagataaacttttgaaacaagaagaaatgaagtcactggcttttgaaaaggctaaattaaaaagagaaaaagcagatgccctagaagcgaagaaaaaagaaaaagaagataaagagaaaaagagggaagaattgaaaaaaattgttgaagaagagagactaaagaaaaaagaagaaaaagagaggcttaaagtagaaagagaaaaggaaagagagaagttacgtgaagaaaagcgaaagtatgtggaatacttaaaacagtggagtaaacctagagaagatatggaatgtgatgaccttaaggaacttccagaaccaacaccagtgaaaactagactacctcctgaaatctttggtgatgctctgatggttttggagttccttaatgcatttggggaactttttgatcttcaagatgagtttcctgatggagtaaccctagaagtattagaggaagctcttgtaggaaatgacagtgaaggcccactgtgtgaattgctttttttcttcctgactgcaatcttccaggcaatagctgaagaagaagaggaagtagccaaagagcaactaactgatgctgacaccaaagatttaacagaggctttggatgaagatgcagaccccacaaaatctgcactgtctgcagttgcatctttggcagctgcatggccacagttacaccagggctgcagtttgaaaagtttggatcttgatagctgcactctttcagaaatcctcagactgcacatcttagcttcaggtgctgatgtaacatcagcaaatgcaaagtatagatatcaaaaacgaggaggatttgatgctacagatgatgcttgtatggagcttcgtttgagcaatcccagtctagtgaagaaactgtcaagcacctcagtgtatgatttgacaccaggagaaaaaatgaagatactccatgctctctgtggaaagctactgaccctagtttcaactagggattttattgaagattatgttgatatattacgacaggcaaagcaggagttccgggaattaaaagcagaacaacatcgaaaagagagggaagaagcagctgccagaattcgtaaaaggaaggaagaaaaacttaaggagcaagaacaaaaaatgaaagagaaacaagaaaaactgaaagaagatgagcaaagaaattcaacggcagatatatctattggggaggaagaaagggaagattttgatactagcattgagagcaaagacacagagcaaaaggaattagatcaagatatggtcactgaagatgaagatgacccaggatcacataaaagaggcagaagggagggagaagggaggctggtggaagggagaactaggggttctgtttccctgtctcagccttcctgcaatgcatggtgtttccttaacaacaaaagtccatttcacctatcaatggcagaatctcctgtgcgtgagcctgtggggaggaggagggctagggactggaatctgcactttggaacagagctggtggaagggag

SEQ ID NO: 307263 - DNA, 3963 bp, Homo sapiens
taacgcctttcacaaatgtttattttgctaggtgtatgaacagttaaagccagcctgaaagataaaaaatactaactcttgatttcgatttcttacattttctgctccaaagtacaaaggaacttaaatttgaagttataaaacggatcccacattgtttctgtaattatcatttcgcagtattggtaataggaataacatctttgtcgaataaccattcctaaaacttacttttagactcattcttacatattaatttgcaaataagcaaatgttaaggacagtatcaaaaaagactttaaaacacatctagtgaacgttctgagttacttctagtttcgaaaattctattgaattccaaggtcacatgtattatgtacattaaacttgtttccctaaataaaagttactgatatgggaaagttgctttaggggaattttcgctagtaaatccataatccttaaaattctaagtgaattaaacattgatactttgcaaatatttacagcagtgtaaatattactttttaaaggtgcgttagtttcaagaatgctggggtcctacaagcatgatgacactttgtaacacatactttttttttggtcttttcctctgctttctaaatctcttaattgccataagtattaaatagaactgatgtcaaggtatcttctgttcaagatggatgtttactaaacatgcaaagtatttttagagatatagattctaatttggaagaagaaaaatagcaacaaattttcttattcatttcttttctcatctttaaaatacaagttaaatcgtaattggaatcccttttcccatcgtgtagtcaagagtctgtgccagacttgaaggctttactttgttagccatgtgtttatgaacccccagcgctttccctagatcttttggctgataatctcaaacatggaggatgcttctgaatcttcacgaggggttgctccattaattaataatgtagttctcccaggctctccgctgtctcttcctgtatcagtgacaggctgtaaaagtcatcgagtagccaataaaaaggtagaagcgaggagtgaaaagctcctcccaacagctcttcctccttcagagccgaaagtagatcagaaacttcccaggagctccgagaggcggggaagtggcggtgggacgcaattccccgcgcggagtcgggcagtggcagcgggagaagcggcagccaggggcgcggcggggccggagagaggcggtcccctgggaggacggggtctcccctcgttgcctttgtagtggagaaggtggacaagtggcagtcggcgtgatcgcagggaagcggggccggcgcgggcggccgagggtccaggcgagcccgcgggcggacgggagatgccgctgctacaccgaaagccgtttgtgagacagaagccgcccgcggacctgcggcccgacgaggaagttttctactgtaaagtcaccaacgagatcttccgccactacgatgacttttttgaacgaaccattctgtgcaacagccttgtgtggagttgtgctgtgacgggtagacctggactgacgtatcaggaagcacttgagtcagaaaaaaaagcaagacagaatcttcagagttttccagaaccactaattattccagttttatacttgaccagccttacccatcgttcgcgcttacatgaaatttgtgatgatatctttgcatatgtcaaggatcgatattttgtcgaagaaactgtggaagtcattaggaacaatggtgcaaggttgcagtgtaggattttggaagtcctccctccatcacatcaaaatggttttgctaatggacatgttaacagtgtggatggagaaactattatcatcagtgatagtgatgattcagaaacacaaagctgttcttttcaaaatgggaagaaaaaagatgcaattgatcccttactattcaagtataaagtgcaacccactaaaaaagaattacatgagtctgctattgttaaagcaacacaaatcagccggagaaaacacctattttctcgtgataaactaaagctttttctgaagcaacactgtgaaccacaagatggagtcattaaaataaaggcatcatctctttcaacgtataaaatagcagaacaagatttttcttatttcttccctgatgatccacccacatttatcttcagtcctgctaacagacgaagagggagacctcccaaacgaatacatattagtcaagaggacaatgttgctaataaacagactcttgcaagttataggagcaaagctactaaagaaagagataaacttttgaaacaagaagaaatgaagtcactggcttttgaaaaggctaaattaaaaagagaaaaagcagatgccctagaagcgaagaaaaaagaaaaagaagataaagagaaaaagagggaagaattgaaaaaaattgttgaagaagagagactaaagaaaaaagaagaaaaagagaggcttaaagtagaaagagaaaaggaaagagagaagttacgtgaagaaaagcgaaagtatgtggaatacttaaaacagtggagtaaacctagagaagatatggaatgtgatgaccttaaggaacttccagaaccaacaccagtgaaaactagactacctcctgaaatctttggtgatgctctgatggttttggagttccttaatgcatttggggaactttttgatcttcaagatgagtttcctgatggagtaaccctagaagtattagaggaagctcttgtaggaaatgacagtgaaggcccactgtgtgaattgctttttttcttcctgactgcaatcttccaggcaatagctgaagaagaagaggaagtagccaaagagcaactaactgatgctgacaccaaagatttaacagaggctttggatgaagatgcagaccccacaaaatctgcactgtctgcagttgcatctttggcagctgcatggccacagttacaccagggctgcagtttgaaaagtttggatcttgatagctgcactctttcagaaatcctcagactgcacatcttagcttcaggtgctgatgtaacatcagcaaatgcaaagtatagatatcaaaaacgaggaggatttgatgctacagatgatgcttgtatggagcttcgtttgagcaatcccagtctagtgaagaaactgtcaagcacctcagtgtatgatttgacaccaggagaaaaaatgaagatactccatgctctctgtggaaagctactgaccctagtttcaactagggattttattgaagattatgttgatatattacgacaggcaaagcaggagttccgggaattaaaagcagaacaacatcgaaaagagagggaagaagcagctgccagaattcgtaaaaggaaggaagaaaaacttaaggagcaaagctactaaagaaagagataaacttttgaaacaagaagaaatgaagtcactggcttttgaaaaggctaaattaaaaagagaaaaagcagatgccctagaagcgaagaaaaaagaaaaagaagataaagagaaaaagagggaagaattgaaaaaaattgttgaagaagagagactaaagaaaaaagaagaaaaagagaggcttaaagtagaaagagaaaaggtattcatttgagtatattagctatactctctacatatagtaatactactctacatatctacacccatggttgatttttaaatgcttttactactttcattcacatttatgaatgtgcatagaaagttgattggtttatctcccttttgctttggaaaatttaacatgcctttacgcatcacttaaaacctcttttagaatgcagttctaaatgatttcattgtttagatttccaattcagggaagatgatatatgtaaaagtttatatgtaaaccttaagaggtaaaatacgctggaatggaattggggtccgagctcgattcg

SEQ ID NO: 307264 - DNA, 2409 bp, Homo sapiens
taacgcctttcacaaatgtttattttgctaggtgtatgaacagttaaagccagcctgaaagataaaaaatactaactcttgatttcgatttcttacattttctgctccaaagtacaaaggaacttaaatttgaagttataaaacggatcccacattgtttctgtaattatcatttcgcagtattggtaataggaataacatctttgtcgaataaccattcctaaaacttacttttagactcattcttacatattaatttgcaaataagcaaatgttaaggacagtatcaaaaaagactttaaaacacatctagtgaacgttctgagttacttctagtttcgaaaattctattgaattccaaggtcacatgtattatgtacattaaacttgtttccctaaataaaagttactgatatgggaaagttgctttaggggaattttcgctagtaaatccataatccttaaaattctaagtgaattaaacattgatactttgcaaatatttacagcagtgtaaatattactttttaaaggtgcgttagtttcaagaatgctggggtcctacaagcatgatgacactttgtaacacatactttttttttggtcttttcctctgctttctaaatctcttaattgccataagtattaaatagaactgatgtcaaggtatcttctgttcaagatggatgtttactaaacatgcaaagtatttttagagatatagattctaatttggaagaagaaaaatagcaacaaattttcttattcatttcttttctcatctttaaaatacaagttaaatcgtaattggaatcccttttcccatcgtgtagtcaagagtctgtgccagacttgaaggctttactttgttagccatgtgtttatgaacccccagcgctttccctagatcttttggctgataatctcaaacatggaggatgcttctgaatcttcacgaggggttgctccattaattaataatgtagttctcccaggctctccgctgtctcttcctgtatcagtgacaggctgtaaaagtcatcgagtagccaataaaaaggtagaagcgaggagtgaaaagctcctcccaacagctcttcctccttcagagccgaaagtagatcagaaacttcccaggagctccgagaggcggggaagtggcggtgggacgcaattccccgcgcggagtcgggcagtggcagcgggagaagcggcagccaggggcgcggcggggccggagagaggcggtcccctgggaggacggggtctcccctcgttgcctttgtagtggagaaggtggacaagtggcagtcggcgtgatcgcagggaagcggggccggcgcgggcggccgagggtccaggcgagcccgcgggcggacgggagatgccgctgctacaccgaaagccgtttgtgagacagaagccgcccgcggacctgcggcccgacgaggaagttttctactgtaaagtcaccaacgagatcttccgccactacgatgacttttttgaacgaaccattctgtgcaacagccttgtgtggagttgtgctgtgacgggtagacctggactgacgtatcaggaagcacttgagtcagaaaaaaaagcaagacagaatcttcagagttttccagaaccactaattattccagttttatacttgaccagccttacccatcgttcgcgcttacatgaaatttgtgatgatatctttgcatatgtcaaggatcgatattttgtcgaagaaactgtggaagtcattaggaacaatggtgcaaggttgcagtgtaggattttggaagtcctccctccatcacatcaaaatggttttgctaatggacatgttaacagtgtggatggagaaactattatcatcagtgatagtgatgattcagaaacacaaagctgttcttttcaaaatgggaagaaaaaagatgcaattgatcccttactattcaagtataaagtgcaacccactaaaaaagaattacatgagtctgctattgttaaagcaacacaaatcagccggagaaaacacctattttctcgtgataaactaaagctttttctgaagcaacactgtgaaccacaagatggagtcattaaaataaaggcatcatctctttcaacgtataaaatagcagaacaagatttttcttatttcttccctgatgatccacccacatttatcttcagtcctgctaacagacgaagagggagacctcccaaacgaatacatattagtcaagaggacaatgttgctaataaacagactcttgcaagttataggagcaaagctactaaagaaagagataaacttttgaaacaagaagaaatgaagtcactggcttttgaaaaggctaaattaaaaagagaaaaagcagatgccctagaagcgaagaaaaaagaaaa

SEQ ID NO: 307265 - DNA, 2736 bp, Homo sapiens
taacgcctttcacaaatgtttattttgctaggtgtatgaacagttaaagccagcctgaaagataaaaaatactaactcttgatttcgatttcttacattttctgctccaaagtacaaaggaacttaaatttgaagttataaaacggatcccacattgtttctgtaattatcatttcgcagtattggtaataggaataacatctttgtcgaataaccattcctaaaacttacttttagactcattcttacatattaatttgcaaataagcaaatgttaaggacagtatcaaaaaagactttaaaacacatctagtgaacgttctgagttacttctagtttcgaaaattctattgaattccaaggtcacatgtattatgtacattaaacttgtttccctaaataaaagttactgatatgggaaagttgctttaggggaattttcgctagtaaatccataatccttaaaattctaagtgaattaaacattgatactttgcaaatatttacagcagtgtaaatattactttttaaaggtgcgttagtttcaagaatgctggggtcctacaagcatgatgacactttgtaacacatactttttttttggtcttttcctctgctttctaaatctcttaattgccataagtattaaatagaactgatgtcaaggtatcttctgttcaagatggatgtttactaaacatgcaaagtatttttagagatatagattctaatttggaagaagaaaaatagcaacaaattttcttattcatttcttttctcatctttaaaatacaagttaaatcgtaattggaatcccttttcccatcgtgtagtcaagagtctgtgccagacttgaaggctttactttgttagccatgtgtttatgaacccccagcgctttccctagatcttttggctgataatctcaaacatggaggatgcttctgaatcttcacgaggggttgctccattaattaataatgtagttctcccaggctctccgctgtctcttcctgtatcagtgacaggctgtaaaagtcatcgagtagccaataaaaaggtagaagcgaggagtgaaaagctcctcccaacagctcttcctccttcagagccgaaagtagatcagaaacttcccaggagctccgagaggcggggaagtggcggtgggacgcaattccccgcgcggagtcgggcagtggcagcgggagaagcggcagccaggggcgcggcggggccggagagaggcggtcccctgggaggacggggtctcccctcgttgcctttgtagtggagaaggtggacaagtggcagtcggcgtgatcgcagggaagcggggccggcgcgggcggccgagggtccaggcgagcccgcgggcggacgggagatgccgctgctacaccgaaagccgtttgtgagacagaagccgcccgcggacctgcggcccgacgaggaagttttctactgtaaagtcaccaacgagatcttccgccactacgatgacttttttgaacgaaccattctgtgcaacagccttgtgtggagttgtgctgtgacgggtagacctggactgacgtatcaggaagcacttgagtcagaaaaaaaagcaagacagaatcttcagagttttccagaaccactaattattccagttttatacttgaccagccttacccatcgttcgcgcttacatgaaatttgtgatgatatctttgcatatgtcaaggatcgatattttgtcgaagaaactgtggaagtcattaggaacaatggtgcaaggttgcagtgtaggattttggaagtcctccctccatcacatcaaaatggttttgctaatggacatgttaacagtgtggatggagaaactattatcatcagtgatagtgatgattcagaaacacaaagctgttcttttcaaaatgggaagaaaaaagatgcaattgatcccttactattcaagtataaagtgcaacccactaaaaaagaattacatgagtctgctattgttaaagcaacacaaatcagccggagaaaacacctattttctcgtgataaactaaagctttttctgaagcaacactgtgaaccacaagatggagtcattaaaataaaggcatcatctctttcaacgtataaaatagcagaacaagatttttcttatttcttccctgatgatccacccacatttatcttcagtcctgctaacagacgaagagggagacctcccaaacgaatacatattagtcaagaggacaatgttgctaataaacagactcttgcaagttataggagcaaagctactaaagaaagagataaacttttgaaacaagaagaaatgaagtcactggcttttgaaaaggctaaattaaaaagagaaaaagcagatgccctagaagcgaagaaaaaagaaaatatcataaaaagaacggaagattttttgtgtcggaccgagctgcgttactaacagacaaaaaaagcgcgagggcgcgccttcaaaaaatcttccccccgcgggacctaccatgctacctcccacatgtggtgtatgacagcgaaccttagataattatacaaacaatagccacggtggcagaccatacactaaaaggcatcaagaaacaaactctagctagaacttataacgacgtaataggacacaaccatgacactcctaggcatacgtacagaaatcagaacaacggataaggggatatgcgcacgacctatacaacgcaagaa

SEQ ID NO: 307266 - DNA, 2085 bp, Homo sapiens
taacgcctttcacaaatgtttattttgctaggtgtatgaacagttaaagccagcctgaaagataaaaaatactaactcttgatttcgatttcttacattttctgctccaaagtacaaaggaacttaaatttgaagttataaaacggatcccacattgtttctgtaattatcatttcgcagtattggtaataggaataacatctttgtcgaataaccattcctaaaacttacttttagactcattcttacatattaatttgcaaataagcaaatgttaaggacagtatcaaaaaagactttaaaacacatctagtgaacgttctgagttacttctagtttcgaaaattctattgaattccaaggtcacatgtattatgtacattaaacttgtttccctaaataaaagttactgatatgggaaagttgctttaggggaattttcgctagtaaatccataatccttaaaattctaagtgaattaaacattgatactttgcaaatatttacagcagtgtaaatattactttttaaaggtgcgttagtttcaagaatgctggggtcctacaagcatgatgacactttgtaacacatactttttttttggtcttttcctctgctttctaaatctcttaattgccataagtattaaatagaactgatgtcaaggtatcttctgttcaagatggatgtttactaaacatgcaaagtatttttagagatatagattctaatttggaagaagaaaaatagcaacaaattttcttattcatttcttttctcatctttaaaatacaagttaaatcgtaattggaatcccttttcccatcgtgtagtcaagagtctgtgccagacttgaaggctttactttgttagccatgtgtttatgaacccccagcgctttccctagatcttttggctgataatctcaaacatggaggatgcttctgaatcttcacgaggggttgctccattaattaataatgtagttctcccaggctctccgctgtctcttcctgtatcagtgacaggctgtaaaagtcatcgagtagccaataaaaaggtagaagcgaggagtgaaaagctcctcccaacagctcttcctccttcagagccgaaagtagatcagaaacttcccaggagctccgagagggcagtggcagcgggagaagcggcagccaggggcgcggcggggccggagagaggcggtcccctgggaggacggggtctcccctcgttgcctttgtagtggagaaggtggacaagtggcagtcggcgtgatcgcaggtgagggtcgctcgggagccggccggcgccggcggggaagtggaggcgagccgggaacaaagcggagcagctccggggtccgcccgcggcgagcgctctggcggcgttgggctggccggccggccagctgcgcgccgagcacgttgtgagcctggcggcggcggcgggcgaggagccggcgctgggggagggggccgccgccgctcccgcactgccccccgcggcggggcgtcctgccccattgtgaggcggcggcaggacgagaggaggtagggcgcgctcggggggcaggggcggcggcggctccgctcgctcgacacccgggcagcggcaggaacgaactcggctccggtagcggccgcggcgcgtcagtcacacaaaaggcagccgagcttctcccagcgcgcggaccggcccacgctgccgccgagggctccccaccttaccggctttcctttccctccaattttgatagggaagcggggccggcgcgggcggccgagggtccaggcgagcccgcgggcggacgggagatgccgctgctacaccgaaagccgtttgtgagacagaagccgcccgcggacctgcggcccgacgaggaagttttctactgtaaagtcaccaacgagatcttccgccactacgagtaagagccgggccgtgtgcggggccgcggggggtgtggggactccccccgcagcgctcttttgtctctctccttttcctcgccctgggcttctggcggggcgacttgaaagtgacgggtggcccccgggcccgcggttctctgcctcctggcct

SEQ ID NO: 307267 - DNA, 278 bp, Homo sapiens
cacttgatcctgggaagcaggatcagcctgggcagaagagtgaaactctgtctcaaaaaaaaaaaaaaaaagcttatgaatgattactacattatagttttataataatgtttgaagtactttccatgatttgattaaagacaagatgctaaaagtgaaatgtatatgtgcatcagatagactaccatatttcattttaacttttagaattcgtaaaaggaaggaagaaaaacttaaggagcaagaacaaaaaatgaaagagaaacaagaaaaactga

SEQ ID NO: 307268 - DNA, 441 bp, Homo sapiens
agagtcagtttcattctccttgaaatgttttcatagtaccttgaacttctcttgttttagtacttattacatattttttaaatgatttgtgtaattatctgttttctctgcaagaccaaaactgtgtcatgttgttcactacttcctaagcctataatgcctggtacttcataagcaagcaataaatatttcataaatggaattatatattcattagtaaatgtcatctttgtttttatcctaaagggaggaagaaagggaagattttgatactagcattgagagcaaagacacagagcaaaaggaattagatcaagatatggtcactgaagatgaagatgacccaggatcacataaaagaggcagaaggggtaatactgaaatttctttagggcattcttgtgtatttgtttttaaccaataaagcactttattaattca

SEQ ID NO: 307269 - DNA, 481 bp, Homo sapiens
aaatattcaagctttgatttgcactagaataaagtatttatttccttaaagatttaacagaggctttggatgaagatgcagaccccacaaaatctgcactgtctgcagttgcatctttggcagctgcatggccacagttacaccagggtatgtgtgggttttgttttttttttgtttggctttttatttttaattttataaaggcacatttacattgctgagtatttattgtttatattctaaatgactatttcatttttaacaactataggctgcagtttgaaaagtttggatcttgatagctgcactctttcagaaatcctcagactgcacatcttagcttcaggtgctgatgtaacatcagcaaatgcaaagtatagatatcaaaaacgaggaggatttgatgctacagatgatgcttgtatggagcttcgtttgagcaatcccagtctagtgaagaaactgtcaagcacctcagtgt

SEQ ID NO: 307270 - DNA, 850 bp, Homo sapiens
gcccggcctcgtgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggggctcttcagagcagcaggacacctgctcaaacccagggccctgctcatcacctacgggccctatgccatcaatgggaagatctccccccagagcaacgtggactttgacctgatgctcagatgcaggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggaaaa

SEQ ID NO: 307271 - DNA, 782 bp, Homo sapiens
gcccggcctcgtgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggggctcttcagagcagcaggacacctgctcaaacccagggccctgctcatcacctacggggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggaaaa

SEQ ID NO: 307272 - DNA, 559 bp, Homo sapiens
gcccggcctcgtgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacaggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggaaaa

SEQ ID NO: 307273 - DNA, 994 bp, Homo sapiens
gcccggcctcgtgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacaggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggaaaaaaaaaacaacaaaaaaaaaaaaccaacaaacaacaaaaccaaccaccaaacaatagaacattaggcacacacaatagcgaagctacaaaaaaaaccatatataataacagagaaaataacaaaagcgtatatgcagcgcagaaacaattgaataagacagacataataataccaagactctcacaaactagggtggatgttatacatagcgggagaggaacagaccgtgtaagacaaaccagaaatcatgtagtcgtgacacacgaagtagacgagtgaacgaaatctctatatggattcgacgcaaccaagaccgaccgagctgacctgtgactgaacgaacagtagcagtcgaagacttcataagcaagatgctgattcatcgcgagtgaagcatgacaatactcgcagagatagctgcaaggacacatgcta

SEQ ID NO: 307274 - DNA, 751 bp, Homo sapiens
gcccggcctcgtgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacaggggctcttcagagcagcaggacacctgctcaaacccagggccctgctcatcacctacggggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctggtggcctctcaggcccgcttgggacggaaagggcccaaggccctggctcaggaaataaggctttgtccttggctggcccaaaaacacgacacagacagacacaacacagcacacaaaacaaaagaaacacatatgtgcgaggcgccgcacagcggcaagcgctctctgaaacagaacatattatcatcaaacagcgt

SEQ ID NO: 307275 - DNA, 1308 bp, Homo sapiens
gcccggcctcgtgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggggctcttcagagcagcaggacacctgctcaaacccagggccctgctcatcacctacgggccctatgccatcaatgggaagatctccccccagagcaacgtggactttgacctgatgctcagatgcaggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggaaaaaaaaaaaaaaaaaaaaaaaaaaaaaaaaaaagggggggggggcttaaaaatttcccccggggggggccaaattttgcgggttccccagagtttctgtgtgtgaacaaaggggggcccctataagggggggctgtctatatatataggatagcgactgtgggcgagggggtttacacaaaggtctgggacaggggaaaactgtggctaaccgtgggaacttttggggggagggacccttatatttccggggggggggaggcaacattattgtggggcaaaatctctccctctacaagaatttttacaacggccccaaggggggaacatttgtaaactttctaaaagggcgatacaccgtgggtgtcaaaaactaaaggggaatatatagcgctggcgtgcttaaaaaaggttgggaaacacgggagagttctgttgtcggaacaacttttttcccgggg

SEQ ID NO: 307276 - DNA, 924 bp, Homo sapiens
gcccggcctcgtgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggggctcttcagagcagcaggacacctgctcaaacccagggccctgctcatcacctacgggccctatgccatcaatgggaagatctccccccagagcaacgtggactttgacctgatgctcagatgcaggaacccagaatgggggcttcgggacacagccctcctggaggacctgggaaaggccagtggcctgctcctggagaggatggtaggtgggggagcgggggcccaggcaacctctctaggggttgagggccgtcctccagcaaagtgtttctccaggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggaaaa

SEQ ID NO: 307277 - DNA, 1136 bp, Homo sapiens
  misc_feature (972)..(972): n is a, c, g, or t
gcccggcctcgtgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggggctcttcagagcagcaggacacctgctcaaacccagggccctgctcatcacctacggggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggaaaaaaaaaaaaaaaaaaaaaaaaaaatccggggcttcttttcgggggggggaaaaaggggttttgaagggccttggccaagggtttccggacccgtttttttgtccccgggggaaatcggcgggcccccaacagggaggcggataaattccgacgaggccaggttaaaccggatagaaatcggcggaaacagnccgggcaaaacccgcgccaatagcgaggtgtgtcggacaccacggagccaaggaaccatgcgcaaaaccggcgtgaccaaaaaaacacgaaccgggggatgcgcgaaacaaacctctacacaggagcccagagagaccaaaggtcacgacgaggccactaaatg

SEQ ID NO: 307278 - DNA, 1172 bp, Homo sapiens
gcccggcctcgtgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggggctcttcagagcagcaggacacctgctcaaacccagggccctgctcatcacctacggggtgagtgggcctgtccacggcgggcctcccgctcccagtcctagctgctgtctcctgccctgctgagagtcctccctcctgggctccctgccccccgcccagccaccagcacggcctcccctccacttccagtctgtacccctccctgggtcatctgccagcctccctacccccttgcccaccaggctggccttggctgactccctcttggggacagggagggggtgccctttcattctccaaaccccagcctgcaagtctgtcccaggctctctgggaaataccccgaccttggtccagtgggctgtgtccccatgcccacccctatgccatcaatgggaagatctccccccagagcaacgtggactttgacctgatgctcagatgcaggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggaaaa

SEQ ID NO: 307279 - DNA, 955 bp, Homo sapiens
gcccggcctcgtgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggggctcttcagagcagcaggacacctgctcaaacccagggccctgctcatcacctacgggggagggggtgccctttcattctccaaaccccagcctgcaagtctgtcccaggctctctgggaaataccccgaccttggtccagtgggctgtgtccccatgcccacccctatgccatcaatgggaagatctccccccagagcaacgtggactttgacctgatgctcagatgcaggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggaaaa

SEQ ID NO: 307280 - DNA, 1169 bp, Homo sapiens
gcccggcctcgtgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacaggtgcggcccccggggcggccacttctatcggtgcggcggtccggggcctcaagagcccacggcccgcagccccggaggaaaaggatgcggctcgggctctgagggtgcggggtgggagcctgggggtgcccccggggcaggccctagctgtgcggcccccgcggctgcggaagtgggtggacctcggggtcccccttcccagccgctttggtctccgctcctcaacgtgccccccagcctcccctaagaaattctgtgggggcgtcggaaaggcgggtgcacaggactcggcccccacccaagcgttcgcctcctgcagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggggctcttcagagcagcaggacacctgctcaaacccagggccctgctcatcacctacgggccctatgccatcaatgggaagatctccccccagagcaacgtggactttgacctgatgctcagatgcaggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggaaaa

SEQ ID NO: 307281 - DNA, 941 bp, Homo sapiens
gcccggcctcgtgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggggctcttcagagcagcaggacacctgctcaaacccagggccctgctcatcacctacgggccctatgccatcaatgggaagatctccccccagagcaacgtggactttgacctgatgctcagatgcaggtcagagctagaggcggggggtctggctcaggtggcaggtggcttgggtggcaccccccaggccatgactccatctccccaccctctgcaggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggaaaa

SEQ ID NO: 307282 - DNA, 944 bp, Homo sapiens
gcccggcctcgtgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggtctgtggggagcccagcatgggtgtctgccgtggcaccactcaccctgcatgggggcagctgggatgccagatttgcccccatcacagtcggggggctcttcagagcagcaggacacctgctcaaacccagggccctgctcatcacctacgggccctatgccatcaatgggaagatctccccccagagcaacgtggactttgacctgatgctcagatgcaggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggaaaa

SEQ ID NO: 307283 - DNA, 1762 bp, Homo sapiens
gcccggcctcgtgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacaggtgcggcccccggggcggccacttctatcggtgcggcggtccggggcctcaagagcccacggcccgcagccccggaggaaaaggatgcggctcgggctctgagggtgcggggtgggagcctgggggtgcccccggggcaggccctagctgtgcggcccccgcggctgcggaagtgggtggacctcggggtcccccttcccagccgctttggtctccgctcctcaacgtgccccccagcctcccctaagaaattctgtgggggcgtcggaaaggcgggtgcacaggactcggcccccacccaagcgttcgcctcctgcagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggtctgtggggagcccagcatgggtgtctgccgtggcaccactcaccctgcatgggggcagctgggatgccagatttgcccccatcacagtcggggtgagggtctccagcctcccccatcacagtcggggtgagggtctccagcctcccccatcacagtcggggtgagggtctccagcctcccccatcacagtcggggtgagggtctccagcctcagggcctggcttctgttgggggcagcacctcactgccgtcctgttcctactcaccaggggctcttcagagcagcaggacacctgctcaaacccagggccctgctcatcacctacggggtgagtgggcctgtccacggcgggcctcccgctcccagtcctagctgctgtctcctgccctgctgagagtcctccctcctgggctccctgccccccgcccagccaccagcacggcctcccctccacttccagtctgtacccctccctgggtcatctgccagcctccctacccccttgcccaccaggctggccttggctgactccctcttggggacagggagggggtgccctttcattctccaaaccccagcctgcaagtctgtcccaggctctctgggaaataccccgaccttggtccagtgggctgtgtccccatgcccacccctatgccatcaatgggaagatctccccccagagcaacgtggactttgacctgatgctcagatgcaggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggaaaa

SEQ ID NO: 307284 - DNA, 1274 bp, Homo sapiens
gcccggcctcgtgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacaggtgcggcccccggggcggccacttctatcggtgcggcggtccggggcctcaagagcccacggcccgcagccccggaggaaaaggatgcggctcgggctctgagggtgcggggtgggagcctgggggtgcccccggggcaggccctagctgtgcggcccccgcggctgcggaagtgggtggacctcggggtcccccttcccagccgctttggtctccgctcctcaacgtgccccccagcctcccctaagaaattctgtgggggcgtcggaaaggcgggtgcacaggactcggcccccacccaagcgttcgcctcctgcagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggggctcttcagagcagcaggacacctgctcaaacccagggccctgctcatcacctacgggggagggggtgccctttcattctccaaaccccagcctgcaagtctgtcccaggctctctgggaaataccccgaccttggtccagtgggctgtgtccccatgcccacccctatgccatcaatgggaagatctccccccagagcaacgtggactttgacctgatgctcagatgcaggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggaaaa

SEQ ID NO: 307285 - DNA, 826 bp, Homo sapiens
gcccggcctcgtgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggggctcttcagagcagcaggacacctgctcaaacccagggccctgctcatcacctacgggtccccccagagcaacgtggactttgacctgatgctcagatgcaggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggaaaa

SEQ ID NO: 307286 - DNA, 964 bp, Homo sapiens
gcccggcctcgtgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggacacagccctcctggaggacctgggaaaggccagtggcctgctcctggagaggatggtggacatgccagccaacaacaaatgcctgatcttccggaaaaactaagcccctccttctccggccagcacgcagcgcacttcgcgcgggccttccccctggccgagtggcagccgtcggacgtggaccagcgctgcctggacagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggggctcttcagagcagcaggacacctgctcaaacccagggccctgctcatcacctacgggccctatgccatcaatgggaagatctccccccagagcaacgtggactttgacctgatgctcagatgcaggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggaaaa

SEQ ID NO: 307287 - DNA, 687 bp, Homo sapiens
gcccggcctcgtgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacaggggctcttcagagcagcaggacacctgctcaaacccagggccctgctcatcacctacgggccctatgccatcaatgggaagatctccccccagagcaacgtggactttgacctgatgctcagatgcaggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggaaaa

SEQ ID NO: 307288 - DNA, 792 bp, Homo sapiens
gcccggcctcgtgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacaggggctcttcagagcagcaggacacctgctcaaacccagggccctgctcatcacctacgggggagggggtgccctttcattctccaaaccccagcctgcaagtctgtcccaggctctctgggaaataccccgaccttggtccagtgggctgtgtccccatgcccacccctatgccatcaatgggaagatctccccccagagcaacgtggactttgacctgatgctcagatgcaggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggaaaa

SEQ ID NO: 307289 - DNA, 1009 bp, Homo sapiens
gcccggcctcgtgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacaggggctcttcagagcagcaggacacctgctcaaacccagggccctgctcatcacctacggggtgagtgggcctgtccacggcgggcctcccgctcccagtcctagctgctgtctcctgccctgctgagagtcctccctcctgggctccctgccccccgcccagccaccagcacggcctcccctccacttccagtctgtacccctccctgggtcatctgccagcctccctacccccttgcccaccaggctggccttggctgactccctcttggggacagggagggggtgccctttcattctccaaaccccagcctgcaagtctgtcccaggctctctgggaaataccccgaccttggtccagtgggctgtgtccccatgcccacccctatgccatcaatgggaagatctccccccagagcaacgtggactttgacctgatgctcagatgcaggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggaaaa

SEQ ID NO: 307290 - DNA, 890 bp, Homo sapiens
gcccggcctcgtgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggtctgtggggagcccagcatgggtgtctgccgtggcaccactcaccctgcatgggggcagctgggatgccagatttgcccccatcacagtcggggaacccagaatgggggcttcgggacacagccctcctggaggacctgggaaaggccagtggcctgctcctggagaggatggtaggtgggggagcgggggcccaggcaacctctctaggggttgagggccgtcctccagcaaagtgtttctccaggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggaaaa

SEQ ID NO: 307291 - DNA, 722 bp, Homo sapiens
gcccggcctcgtgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggaaaa

SEQ ID NO: 307292 - DNA, 1372 bp, Homo sapiens
gcccggcctcgtgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacaggtgcggcccccggggcggccacttctatcggtgcggcggtccggggcctcaagagcccacggcccgcagccccggaggaaaaggatgcggctcgggctctgagggtgcggggtgggagcctgggggtgcccccggggcaggccctagctgtgcggcccccgcggctgcggaagtgggtggacctcggggtcccccttcccagccgctttggtctccgctcctcaacgtgccccccagcctcccctaagaaattctgtgggggcgtcggaaaggcgggtgcacaggactcggcccccacccaagcgttcgcctcctgcagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggtctgtggggagcccagcatgggtgtctgccgtggcaccactcaccctgcatgggggcagctgggatgccagatttgcccccatcacagtcggggtgagggtctccagcctcccccatcacagtcggggtgagggtctccagcctcccccatcacagtcggggtgagggtctccagcctcccccatcacagtcggggtgagggtctccagcctcagggcctggcttctgttgggggcagcacctcactgccgtcctgttcctactcaccaggggctcttcagagcagcaggacacctgctcaaacccagggccctgctcatcacctacggggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggaaaa

SEQ ID NO: 307293 - DNA, 566 bp, Homo sapiens
atcagccacaggccaggccaggtcaggagaaattctcctaggcactgccaggccaggaaggcccagctgcatctgggccctgccagaatgtggcacaagaaagtggatgggcataggggtagttctacctagtttattgtttctcaagaagggcctcctatgggaaagcacctaacaaggaggttgtggacatgggatgtccctatgccatcaatgggaagatctccccccagagcaacgtggactttgacctgatgctcagatgcaggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggaaaa

SEQ ID NO: 307294 - DNA, 1203 bp, Homo sapiens
gcccggcctcgtgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacaggtgcggcccccggggcggccacttctatcggtgcggcggtccggggcctcaagagcccacggcccgcagccccggaggaaaaggatgcggctcgggctctgagggtgcggggtgggagcctgggggtgcccccggggcaggccctagctgtgcggcccccgcggctgcggaagtgggtggacctcggggtcccccttcccagccgctttggtctccgctcctcaacgtgccccccagcctcccctaagaaattctgtgggggcgtcggaaaggcgggtgcacaggactcggcccccacccaagcgttcgcctcctgcagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggaacccagaatgggggcttcgggacacagccctcctggaggacctgggaaaggccagtggcctgctcctggagaggatggtggacatgccagccaacaacaaatgcctgatcttccggcgtggcggggccttgtacgcgtacaaggccccgcacggagtacagtgtggccgtgcagacggcagtgaagcagagcgatggggagtacctggtgtccggctggagcgagacggtggagttctgcactggggattatgccaaggagcacctggctcagcttcaggagaaagctgagcagatcgcaggccgcatgctccgcttctccgtcttctaccgcaaccatcacaaggagtacttccagcatgccaggacccactgcgggaacatgctgcagccttacctgaaggacaacagcggcagccacggctcccccaccagcggtatgctccacggccttgtacg

SEQ ID NO: 307295 - DNA, 643 bp, Homo sapiens
gcccggcctcgtgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggaaaa

SEQ ID NO: 307296 - DNA, 619 bp, Homo sapiens
gcccggcctcgtgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacaggggctcttcagagcagcaggacacctgctcaaacccagggccctgctcatcacctacggggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggaaaa

SEQ ID NO: 307297 - DNA, 665 bp, Homo sapiens
gttcaacaccgtcaagggctcccccactggggttgtaagtctgggctccggggacccccggttcacccactggttgggtcaacccccccgaaaaaagaaggtttggccccctaacaaccccctgttgcttacgtgacaaacgctttctaaggattccggggtctaaaaacaaataagggcattgctccaggggcctctttatcatcgatggcaagggtgtccttcgccagatcactgttaatgatttgcctgtgggacgctccgtggatgaggctctgcggctggtccaggccttccagtacacagacgagcatggggaagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtg

SEQ ID NO: 307298 - DNA, 161 bp, Homo sapiens
gcggccgcctactactactagcctactactactactgctcgaattcaagcttctaacgatgtacggggatccacctagaagctgaatagtgacgccctcccccaagcccacccagccgcacacaggcctagaggtaaccaataaagtattagggaaaggtg

SEQ ID NO: 307299 - DNA, 1145 bp, Homo sapiens
gagagagagagagagagagagagagagagagagagagagagagagagagagagagagagagagagagagagccgctccgctcgtccgctccctcccccgcgccgtgcacgtcttggttcgggccgggcataaaaggcttcgcggcccaggctcacttggcgctgagaacgcgggtccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggatcaacaccccccggaaagagggaggcttgggccccctgaacatccccctgcttgctgacgtgaccagacgcttgtctgaggattacggcgtgctgaaaacagatgagggcattgcctacaggggcctctttatcatcgatggcaagggtgtccttcgccagatcactgttaatgatttgcctgtgggacgctccgtggatgaggctctgcggctggtccaggccttccagtacacagacgagcatggggaagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtgaaacacaacacaaacaaacaaaacaccgaggcctacactcaggcacggagaaaaggccaacag

SEQ ID NO: 307300 - DNA, 1415 bp, Homo sapiens
gagagagagagagagagagagagagagagagagagagagagagagagagagagagagagagagagagagagccgctccgctcgtccgctccctcccccgcgccgtgcacgtcttggttcgggccgggcataaaaggcttcgcggcccaggctcacttggcgctgagaacgcgggtccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggatcaacaccccccggaaagagggaggcttgggccccctgaacatccccctgcttgctgacgtgaccagacgcttgtctgaggattacggcgtgctgaaaacagatgagggcattgcctacaggggcctctttatcatcgatggcaagggtgtccttcgccagatcactgttaatgatttgcctgtgggacgctccgtggatgaggctctgcggctggtccaggccttccagtacacagacgagcatggggaagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtgaaaaaaaaaaacaacacaacacaagccgacgaaggaagccagtcgccatcggggactacacaaaatggggcgggtgtggagcacagaagcgaaaaaaggcacgagaacgcgagagaaccacaaacaccagcatacgaacggcgcagaaaaacaccatccccgtggtcacgagaacaaacatcttacaatgaacacccggcagagtgggacccgcgagagaaagacagaaagccccaatggacgcacgggagcatacagcgaaacctgatagcgcaacgtgacacgacaccacacaaaagacacgaaggagacgaaaacaacaggaagcacaca

SEQ ID NO: 307301 - DNA, 1516 bp, Homo sapiens
gagagagagagagagagagagagagagagagagagagagagagagagagagagagagagagagagagagagccgctccgctcgtccgctccctcccccgcgccgtgcacgtcttggttcgggccgggcataaaaggcttcgcggcccaggctcacttggcgctgagaacgcgggtccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggatcaacaccccccggaaagagggaggcttgggccccctgaacatccccctgcttgctgacgtgaccagacgcttgtctgaggattacggcgtgctgaaaacagatgagggcattgcctacaggggcctctttatcatcgatggcaagggtgtccttcgccagatcactgttaatgatttgcctgtgggacgctccgtggatgaggctctgcggctggtccaggccttccagtacacagacgagcatggggaagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtggaacagggtgaccgcccacacacacaacgacaaaacgacaacgtacacaacacaaagaacaagaccaaagaaacgaatgacacgagatcacacaatgatagtgcagcgacaacagcagacggcgagtgatatatacacgaccgcagcgcaccagattaagaaacggcacttagtagagaagaaacgaaggaagcacaatactacgagagcacgccaaccacaacgacgagctcaacgaagaggcgatgcagcacacacaaggcaggcaacacgaaacacacacagacacacgcaacaaacgagtgcaacgagcggcgaggagtcacaagcaacaaaaaaaacaaagagcagacgaaggcactcaggtgcactccacgcgcggcgcgaccccagcagaaaagacagaagacaacaaaagaacagacgacaaaaca

SEQ ID NO: 307302 - DNA, 1521 bp, Homo sapiens
gagagagagagagagagagagagagagagagagagagagagagagagagagagagagagagagagagagagccgctccgctcgtccgctccctcccccgcgccgtgcacgtcttggttcgggccgggcataaaaggcttcgcggcccaggctcacttggcgctgagaacgcgggtccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggatcaacaccccccggaaagagggaggcttgggccccctgaacatccccctgcttgctgacgtgaccagacgcttgtctgaggattacggcgtgctgaaaacagatgagggcattgcctacaggggcctctttatcatcgatggcaagggtgtccttcgccagatcactgttaatgatttgcctgtgggacgctccgtggatgaggctctgcggctggtccaggccttccagtacacagacgagcatggggaagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtgaaaaaaaaaacaaaaaaaaaaaaaaaaaaagggggggcggggcaccaaaagaacccccgggggggccacacgacgggaacccgttgggccccactgggggcccccagtataggcgggacgccgaatacattaacgcgcatacgcgcaccgcgccccaccgtacacaaaaacacgccgcgcgtcggggcacaccacggcacagccgcgtgggcacatgctgcgggccaaacgcccgccactacactgcgcggcggggtggcacccaaccgcggcacaccaccacaccctacccgggcaaaatccgcgccccacgacgggtcccaacacagcacgcgcagagacgcaccagcccctgcacccctccccgccaactccccgcgaccacaacctgcgcaccgggacaatcacaacgcacacctatcccccgggcgcgggcgaa

SEQ ID NO: 307303 - DNA, 1112 bp, Homo sapiens
  misc_feature (1029)..(1029): n is a, c, g, or t
gagagagagagagagagagagagagagagagagagagagagagagagagagagagagagagagagagagagccgctccgctcgtccgctccctcccccgcgccgtgcacgtcttggttcgggccgggcataaaaggcttcgcggcccaggctcacttggcgctgagaacgcgggtccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggatcaacaccccccggaaagagggaggcttgggccccctgaacatccccctgcttgctgacgtgaccagacgcttgtctgaggattacggcgtgctgaaaacagatgagggcattgcctacaggggcctctttatcatcgatggcaagggtgtccttcgccagatcactgttaatgatttgcctgtgggacgctccgtggatgaggctctgcggctggtccaggccttccagtacacagacgagcatggggaagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctcactaaagtgaaatggaggcctccaagccccagcgganaggaaggacccaagctggcggacgaaaacaaaaacacacagcacaacaaaacgctgcgcgcgaaaagggtcctagacgcagaa

SEQ ID NO: 307304 - DNA, 1552 bp, Homo sapiens
  misc_feature (374)..(374): n is a, c, g, or t
gagagagagagagagagagagagagagagagagagagagagagagagagagagagagagagagagagagagccgctccgctcgtccgctccctcccccgcgccgtgcacgtcttggttcgggccgggcataaaaggcttcgcggcccaggctcacttggcgctgagaacgcgggtccacgcgtgtgatcgtccgtgcgtctagcctttgcccacgcagggtatgaacacccggagtgcacctggcgggaggacccccttcaggctgctttggcccgatcctgactttagtgctggccgcctttgctttccatccgctatagtggcctcctttgtccttgcgggggaaaccgaggccacagccttgcagcgcagncctgatcgcccgacttcccgccccctgctcgtgcgggcctcactgtctccttctgggctgggggcttgcgacaccgccctccggccgactcgctcgtggggtgctggtggcagtggctgggtcactcgtgctctggtcaggagagcgggtctccggcagcctccgggcctcgtagaccgggtacccgggagggtgagggttagtgctgtcgcctccgccgtgctgactcagtcatagggcccagcacgcagcgcgaccttgggttgggaggacaaagtgtcttcccgggcgcactgaccgggcgggggtctcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggatcaacaccccccggaaagagggaggcttgggccccctgaacatccccctgcttgctgacgtgaccagacgcttgtctgaggattacggcgtgctgaaaacagatgagggcattgcctacaggggcctctttatcatcgatggcaagggtgtccttcgccagatcactgttaatgatttgcctgtgggacgctccgtggatgaggctctgcggctggtccaggccttccagtacacagacgagcatggggaagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtg

SEQ ID NO: 307305 - DNA, 966 bp, Homo sapiens
gagagagagagagagagagagagagagagagagagagagagagagagagagagagagagagagagagagagccgctccgctcgtccgctccctcccccgcgccgtgcacgtcttggttcgggccgggcataaaaggcttcgcggcccaggctcacttggcgctgagaacgcgggtccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggatcaacaccccccggaaagagggaggcttgggccccctgaacatccccctgcttgctgacgtgaccagacgcttgtctgaggattacggcgtgctgaaaacagatgagggcattgcctacaggggcctctttatcatcgatggcaagggtgtccttcgccagatcactgttaatgatttgcctgtgggacgctccgtggatgaggctctgcggctggtccaggccttccagtacacagacgagcatggggaagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgccccctggtgcctatgtgccaggaaggggaatgcctccaatccagatggccgggggggtctgcccatgtggggcgcccc

SEQ ID NO: 307306 - DNA, 1020 bp, Homo sapiens
gagagagagagagagagagagagagagagagagagagagagagagagagagagagagagagagagagagagccgctccgctcgtccgctccctcccccgcgccgtgcacgtcttggttcgggccgggcataaaaggcttcgcggcccaggctcacttggcgctgagaacgcgggtccacgcgtgtgatcgtccgtgcgtctagcctttgcccacgcagagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggatcaacaccccccggaaagagggaggcttgggccccctgaacatccccctgcttgctgacgtgaccagacgcttgtctgaggattacggcgtgctgaaaacagatgagggcattgcctacaggggcctctttatcatcgatggcaagggtgtccttcgccagatcactgttaatgatttgcctgtgggacgctccgtggatgaggctctgcggctggtccaggccttccagtacacagacgagcatggggaagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtg

SEQ ID NO: 307307 - DNA, 1641 bp, Homo sapiens
  misc_feature (374)..(374): n is a, c, g, or t
gagagagagagagagagagagagagagagagagagagagagagagagagagagagagagagagagagagagccgctccgctcgtccgctccctcccccgcgccgtgcacgtcttggttcgggccgggcataaaaggcttcgcggcccaggctcacttggcgctgagaacgcgggtccacgcgtgtgatcgtccgtgcgtctagcctttgcccacgcagggtatgaacacccggagtgcacctggcgggaggacccccttcaggctgctttggcccgatcctgactttagtgctggccgcctttgctttccatccgctatagtggcctcctttgtccttgcgggggaaaccgaggccacagccttgcagcgcagncctgatcgcccgacttcccgccccctgctcgtgcgggcctcactgtctccttctgggctgggggcttgcgacaccgccctccggccgactcgctcgtggggtgctggtggcagtggctgggtcactcgtgctctggtcaggagagcgggtctccggcagcctccgggcctcgtagaccgggtacccgggagggtgagggttagtgctgtcgcctccgccgtgctgactcagtcatagggcccagcacgcagcgcgaccttgggttgggaggacaaagtgtcttcccgggcgcactgaccgggcgggggtctcagctttcagtcatggcctccggtaacgcgcgcatcggaaagccagcccctgacttcaaggccacagcggtggttgatggcgccttcaaagaggtgaagctgtcggactacaaaggtgagcgccgcccggagggggcccaggtagaagcggggccgtgcatgagagaagctgggccctaactcctctgtgtccctcctccccagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggatcaacaccccccggaaagagggaggcttgggccccctgaacatccccctgcttgctgacgtgaccagacgcttgtctgaggattacggcgtgctgaaaacagatgagggcattgcctacaggggcctctttatcatcgatggcaagggtgtccttcgccagatcactgttaatgatttgcctgtgggacgctccgtggatgaggctctgcggctggtccaggccttccagtacacagacgagcatggggaagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtg

SEQ ID NO: 307308 - DNA, 812 bp, Homo sapiens
agccgcacacaggcctagaggtaaccaataaagtattagggaaaggtgaaggcatgagaaggccttggcctagccctccaggtcccatactgtggagttggaggggcaggtctggccttatcatcgcgttcagcaaccgtgcagaggacttccgcaagctgggctgtgaagtgctgggcgtctcggtggactctcagttcacccacctggcttggatcaacaccccccggaaagagggaggcttgggccccctgaacatccccctgcttgctgacgtgaccagacgcttgtctgaggattacggcgtgctgaaaacagatgagggcattgcctacaggggcctctttatcatcgatggcaagggtgtccttcgccagatcactgttaatgatttgcctgtgggacgctccgtggatgaggctctgcggctggtccaggccttccagtacacagacgagcatggggaagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtg

SEQ ID NO: 307309 - DNA, 986 bp, Homo sapiens
  misc_feature (855)..(856): n is a, c, g, or t
  misc_feature (862)..(862): n is a, c, g, or t
  misc_feature (872)..(872): n is a, c, g, or t
  misc_feature (875)..(876): n is a, c, g, or t
  misc_feature (878)..(878): n is a, c, g, or t
  misc_feature (884)..(884): n is a, c, g, or t
  misc_feature (886)..(886): n is a, c, g, or t
  misc_feature (896)..(896): n is a, c, g, or t
  misc_feature (905)..(905): n is a, c, g, or t
  misc_feature (907)..(907): n is a, c, g, or t
  misc_feature (910)..(910): n is a, c, g, or t
  misc_feature (923)..(923): n is a, c, g, or t
  misc_feature (940)..(940): n is a, c, g, or t
gagagagagagagagagagagagagagagagagagagagagagagagagagagagagagagagagagagagccgctccgctcgtccgctccctcccccgcgccgtgcacgtcttggttcgggccgggcataaaaggcttcgcggcccaggctcacttggcgctgagaacgcgggtccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggatcaacaccccccggaaagagggaggcttgggccccctgaacatccccctgcttgctgacgtgaccagacgcttgtctgaggattacggcgtgctgaaaacagatgagggcattgcctacaggggcctctttatcatcgatggcaagggtgtccttcgccagatcactgttaatgatttgcctgtgggacgctccgtggatgaggctctgcggctggtccaggccttccagtacacagacgagcatggggaagtttgtcccgctggctggaagcctggcagtgacacgattaagcccaacgtggatgacagcaaggaatatttctccaaacacaattaggctggctaacggatagtgagcttgtgaaaannaatagntgaatgtganggnngnaaaaangngaaaaaaaangggtgaaanangangtaaaaggaaggnaaagaaatgaaaataanagataaaaagtatgggaaaatggagggataggaaagggaattataa

SEQ ID NO: 307310 - DNA, 967 bp, Homo sapiens
gagagagagagagagagagagagagagagagagagagagagagagagagagagagagagagagagagagagccgctccgctcgtccgctccctcccccgcgccgtgcacgtcttggttcgggccgggcataaaaggcttcgcggcccaggctcacttggcgctgagaacgcgggtccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcagatcaacaccccccggaaagagggaggcttgggccccctgaacatccccctgcttgctgacgtgaccagacgcttgtctgaggattacggcgtgctgaaaacagatgagggcattgcctacaggggcctctttatcatcgatggcaagggtgtccttcgccagatcactgttaatgatttgcctgtgggacgctccgtggatgaggctctgcggctggtccaggccttccagtacacagacgagcatggggaagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtg

SEQ ID NO: 307311 - DNA, 928 bp, Homo sapiens
gagagagagagagagagagagagagagagagagagagagagagagagagagagagagagagagagagagagccgctccgctcgtccgctccctcccccgcgccgtgcacgtcttggttcgggccgggcataaaaggcttcgcggcccaggctcacttggcgctgagaacgcgggtccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaaggatcaacaccccccggaaagagggaggcttgggccccctgaacatccccctgcttgctgacgtgaccagacgcttgtctgaggattacggcgtgctgaaaacagatgagggcattgcctacaggggcctctttatcatcgatggcaagggtgtccttcgccagatcactgttaatgatttgcctgtgggacgctccgtggatgaggctctgcggctggtccaggccttccagtacacagacgagcatggggaagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtg

SEQ ID NO: 307312 - DNA, 673 bp, Homo sapiens
tggcccgataatgacagcatttacaaccccgaagcgctagatatcacagagggaactctgcattctcgcttcgtggagcgtgtccgcaatgttgccagtgtctgtctgcagattggctatccccctgcttgctgacgtgaccagacgcttgtctgaggattacggcgtgctgaaaacagatgagggcattgcctacaggggcctctttatcatcgatggcaagggtgtccttcgccagatcactgttaatgatttgcctgtgggacgctccgtggatgaggctctgcggctggtccaggccttccagtacacagacgagcatggggaagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtg

SEQ ID NO: 307313 - DNA, 1149 bp, Homo sapiens
gagagagagagagagagagagagagagagagagagagagagagagagagagagagagagagagagagagagccgctccgctcgtccgctccctcccccgcgccgtgcacgtcttggttcgggccgggcataaaaggcttcgcggcccaggctcacttggcgctgagaacgcgggtccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggatcaacaccccccggaaagagggaggcttgggccccctgaacatccccctgcttgctgacgtgaccagacgcttgtctgaggattacggcgtgctgaaaacagatgagggcattgcctacaggggcctctttatcatcgatggcaagggtgtccttcgccagatcactgttaatgatttgcctgtgggacgctccgtggatgaggctctgcggctggtccaggccttccagtacacagacgagcatggggaaggcccttgctttgcttcaccttgaacctggggctgtagccttcatgtgcatccttgtgtcttcccacatttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtg

SEQ ID NO: 307314 - DNA, 2426 bp, Homo sapiens
gagagagagagagagagagagagagagagagagagagagagagagagagagagagagagagagagagagagccgctccgctcgtccgctccctcccccgcgccgtgcacgtcttggttcgggccgggcataaaaggcttcgcggcccaggctcacttggcgctgagaacgcgggtccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggatcaacaccccccggaaagagggaggcttgggccccctgaacatccccctgcttgctgacgtgaccagacgcttgtctgaggattacggcgtgctgaaaacagatgagggcattgcctacaggggcctctttatcatcgatggcaagggtgtccttcgccagatcactgttaatgatttgcctgtgggacgctccgtggatgaggctctgcggctggtccaggccttccagtacacagacgagcatggggaagggtgagcagatacacacatgacacatgggtacatactgagcgcctccgtcactcatgcaaacattcactgcctgtcctcttacctgtccagatgggtgttagggccccaaagaagattcagctcagggctttgtctgcaggatgtttctaatgtggtaggagacaaataacgcctgacattcaaccaaggtggacaaaggggccgggctcagtggctcacggttgtattgccagcactttgggaagctgtggcaggtggatcacctgaggtcaggagttcgagaccagcctgaccaacatggtgaaaccccgtctctacgaagaacacaaaaaattagctggccgtggtggtgcacacttgtaatcccagctacttgagagactgaggcaggagttcgcttgaacccaggaggcagaggttgcagtgagctgagatcgcaccgttgtactccagcttgggcaacagagcaaaactcagtctcaaaaaaaaaaaaaattagcttggtttgtgaagcatgcctatagtcccagctactcaagaggctgaggctggaggatcacttgagcctgggaggtcaaggctgcagtaagctgtgatcgcaccactgcactccagcctgggtgacacagcaagaccctgtctcaaaaaaacaaacaaacaggccgagcgcggtggctcacgcctgtaatcccagcactttgggaggccgaggcgggcagatcatgaggtcaggagtttgagaccagcctggccaacatagtgaaaccgcgtctctgctaaaaatacaaaaaaattagctgggtgcggtggcaggtgcctgtaatcccagctacttgggaggctgaggcaggagactcccttgaacccgggaggaggttgcagtaagccgagatcacaccactgcactccagcctgggcgccagtgtgagactccatctcaaaaacaacaacaacaaaaaaacctgtaggggtggggcagagggacaaagatgggactaaaggagccaaaaagacaggaagatgctgtgtctcatgcctgtagatgctgtgtctcatgcctgtagttccacctactctggagagtgaggcagaagattgcttaggcccaggaatttgagtcgagcctaggcaacatagcaataccccatctcttttttttttttttttaagagatggggtattggttaaaaaaaaaaaaaaaaaaaaagaggccagatgcagtggctcacacctgtaatcccagcattttgggaggcctaggtgggtggatcacctgaggtcgggagttcgagacaagcttgaccgacatggagaaacccagtctctactaaaaatacaaaattagcccagcctggtggtgcatgcctgtaatcccagctacttgggaggctgaggcaagagaatcgtttgaagctgagaggcggaggttgcagtgagctgagatcgtgccattgcactccagcctgggcaacgagtgaagcgaaactccgtctcaaaaaataaaaaaaaaaaagaggccgggcacggtggctcatgcctgtaatcccaccactttgggaggctgaggcgggcggatcaagaggtcaggagatcgagaccatcctagctaacgcggtgaaaccctgtctctactaaaaatacaaaaaaattagtcgggcgtggtggcgggcgcctgtagtcccagcta

SEQ ID NO: 307315 - DNA, 836 bp, Homo sapiens
gagagagagagagagagagagagagagagagagagagagagagagagagagagagagagagagagagagagccgctccgctcgtccgctccctcccccgcgccgtgcacgtcttggttcgggccgggcataaaaggcttcgcggcccaggctcacttggcgctgagaacgcgggtccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcagatcaacaccccccggaaagagggaggcttgggccccctgaacatccccctgcttgctgacgtgaccagacgcttgtctgaggattacggcgtgctgaaaacagatgagggcattgcctacagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtg

SEQ ID NO: 307316 - DNA, 1222 bp, Homo sapiens
  misc_feature (374)..(374): n is a, c, g, or t
gagagagagagagagagagagagagagagagagagagagagagagagagagagagagagagagagagagagccgctccgctcgtccgctccctcccccgcgccgtgcacgtcttggttcgggccgggcataaaaggcttcgcggcccaggctcacttggcgctgagaacgcgggtccacgcgtgtgatcgtccgtgcgtctagcctttgcccacgcagggtatgaacacccggagtgcacctggcgggaggacccccttcaggctgctttggcccgatcctgactttagtgctggccgcctttgctttccatccgctatagtggcctcctttgtccttgcgggggaaaccgaggccacagccttgcagcgcagncctgatcgcccgacttcccgccccctgctcgtgcgggcctcactgtctccttctgggctgggggcttgcgacaccgccctccggccgactcgctcgtggggtgctggtggcagtggctgggtcactcgtgctctggtcaggagagcgggtctccggcagcctccgggcctcgtagaccgggtacccgggagggtgagggttagtgctgtcgcctccgccgtgctgactcagtcatagggcccagcacgcagcgcgaccttgggttgggaggacaaagtgtcttcccgggcgcactgaccgggcgggggtctcagctttcagtcatggcctccggtaacgcgcgcatcggaaagccagcccctgacttcaaggccacagcggtggttgatggcgccttcaaagaggtgaagctgtcggactacaaaggtgagcgccgcccggagggggcccaggtagaagcggggccgtgcatgagagaagctgggccctaactcctctgtgtccctcctccccagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttgtgctgtccagctgtccacagcacagaggaggccaatcccctctgcaccttttgtgctttggaattccacagccccacacctgcccccagcctagagaagcctgtgggaacacaatgacttggccaccttcaggaaccaagaggagtaaactggactgggcaggagggcacagactggtc

SEQ ID NO: 307317 - DNA, 1082 bp, Homo sapiens
gagagagagagagagagagagagagagagagagagagagagagagagagagagagagagagagagagagagccgctccgctcgtccgctccctcccccgcgccgtgcacgtcttggttcgggccgggcataaaaggcttcgcggcccaggctcacttggcgctgagaacgcgggtccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggatcaacaccccccggaaagagggaggcttgggccccctgaacatccccctgcttgctgacgtgaccagacgcttgtctgaggattacggcgtgctgaaaacagatgagggcattgcctacaggggcctctttatcatcgatggcaagggtgtccttcgccagatcactgttaatgatttgcctgtgggacgctccgtggatgaggctctgcggctggtccaggccttccagtacacagacgagcatggggaagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtg

SEQ ID NO: 307318 - DNA, 1130 bp, Homo sapiens
gagagagagagagagagagagagagagagagagagagagagagagagagagagagagagagagagagagagccgctccgctcgtccgctccctcccccgcgccgtgcacgtcttggttcgggccgggcataaaaggcttcgcggcccaggctcacttggcgctgagaacgcgggtccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggatcaacaccccccggaaagagggaggcttgggccccctgaacatccccctgcttgctgacgtgaccagacgcttgtctgaggattacggcgtgctgaaaacagatgagggcattgcctacaggggcctctttatcatcgatggcaagggtgtccttcgccagatcactgttaatgatttgcctgtgggacgctccgtggatgaggctctgcggctggtccaggccttccagtacacagacgagcatggggaagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtgaaaaaaaaaaaaaagtcgacgcggccgcgaatttagtagtagtagtcg

SEQ ID NO: 307319 - DNA, 1275 bp, Homo sapiens
gagagagagagagagagagagagagagagagagagagagagagagagagagagagagagagagagagagagccgctccgctcgtccgctccctcccccgcgccgtgcacgtcttggttcgggccgggcataaaaggcttcgcggcccaggctcacttggcgctgagaacgcgggtccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggatcaacaccccccggaaagagggaggcttgggccccctgaacatccccctgcttgctgacgtgaccagacgcttgtctgaggattacggcgtgctgaaaacagatgagggcattgcctacaggggcctctttatcatcgatggcaagggtgtccttcgccagatcactgttaatgatttgcctgtgggacgctccgtggatgaggctctgcggctggtccaggccttccagtacacagacgagcatggggaagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtgaccaacacacatgaacctcgggcattatttcgcggcgcgaaacagtggatatcactgccatggactagtttcgccaatttgtagaagggcattcagctccatatggacgatataatcgacggcctttagctgcagggacacacgccccaccgcgtgacacaccgctacttcagccgagaagtgacgcctatgc

SEQ ID NO: 307320 - DNA, 973 bp, Homo sapiens
aacccaccccacccccccacaccaccattaggcaggtacagccgggtgtgaatcggacgaggcactccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggatcaacaccccccggaaagagggaggcttgggccccctgaacatccccctgcttgctgacgtgaccagacgcttgtctgaggattacggcgtgctgaaaacagatgagggcattgcctacaggggcctctttatcatcgatggcaagggtgtccttcgccagatcactgttaatgatttgcctgtgggacgctccgtggatgaggctctgcggctggtccaggccttccagtacacagacgagcatggggaagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtg

SEQ ID NO: 307321 - DNA, 923 bp, Homo sapiens
  misc_feature (13)..(13): n is a, c, g, or t
  misc_feature (19)..(19): n is a, c, g, or t
  misc_feature (23)..(23): n is a, c, g, or t
  misc_feature (41)..(41): n is a, c, g, or t
attcggcacaggncggganaaangtgtgatcgtccgtgcgnctagctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggatcaacaccccccggaaagagggaggcttgggccccctgaacatccccctgcttgctgacgtgaccagacgcttgtctgaggattacggcgtgctgaaaacagatgagggcattgcctacaggggcctctttatcatcgatggcaagggtgtccttcgccagatcactgttaatgatttgcctgtgggacgctccgtggatgaggctctgcggctggtccaggccttccagtacacagacgagcatggggaagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtg

SEQ ID NO: 307322 - DNA, 1144 bp, Homo sapiens
gagagagagagagagagagagagagagagagagagagagagagagagagagagagagagagagagagagagccgctccgctcgtccgctccctcccccgcgccgtgcacgtcttggttcgggccgggcataaaaggcttcgcggcccaggctcacttggcgctgagaacgcgggtccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggatcaacaccccccggaaagagggaggcttgggccccctgaacatccccctgcttgctgacgtgaccagacgcttgtctgaggattacggcgtgctgaaaacagatgagggcattgcctacaggggcctctttatcatcgatggcaagggtgtccttcgccagatcactgttaatgatttgcctgtgggacgctccgtggatgaggctctgcggctggtccaggccttccagtacacagacgagcatggggaagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctcaatccaagtatgggactgaaggtagcaagcttaagctcacaaaatgtaggaggcccccaaacacaccacggaaagctgaggtacgaagttctgacggaaaaacacaaaaaaaggggcaagcacgggcacagacactgtaaggcccaaggaaaaagcggaaaggaagaggtcaaccgagacacaacaatattagaataaaaatcaac

SEQ ID NO: 307323 - DNA, 1269 bp, Homo sapiens
gagagagagagagagagagagagagagagagagagagagagagagagagagagagagagagagagagagagccgctccgctcgtccgctccctcccccgcgccgtgcacgtcttggttcgggccgggcataaaaggcttcgcggcccaggctcacttggcgctgagaacgcgggtccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggatcaacaccccccggaaagagggaggcttgggccccctgaacatccccctgcttgctgacgtgaccagacgcttgtctgaggattacggcgtgctgaaaacagatgagggcattgcctacaggtactgtgggaccctcagcccggctcagggagcgccctgccccccattcctgtgatgctgggaccactcctgtacaatgtcttctctgcccccagccctgtggctagcagcgggtggttggtagtcccttccttgtctctggcagtgggagctatcagctcctcactgggaaccctgatgtcttcaggggcctctttatcatcgatggcaagggtgtccttcgccagatcactgttaatgatttgcctgtgggacgctccgtggatgaggctctgcggctggtccaggccttccagtacacagacgagcatggggaagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtg

SEQ ID NO: 307324 - DNA, 1698 bp, Homo sapiens
  misc_feature (875)..(875): n is a, c, g, or t
gagagagagagagagagagagagagagagagagagagagagagagagagagagagagagagagagagagagccgctccgctcgtccgctccctcccccgcgccgtgcacgtcttggttcgggccgggcataaaaggcttcgcggcccaggctcacttggcgctgagaacgcgggtccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttgggtatgagcaggggccaaagagggaggttgcagctaagctcacaccctcaggtcctagcagtgtggcttcgtggccattgctcaacctctggaacctgcgtttccccatcgtgaaaataatggaaacattgccgcccaagtctttaaggatgatgacagtaattagcatttgacaactagttgcctggtatatagagttgcagatgcaactcagatgcaactctatctactctatgtacttagttcccaggagggaggctgtgctgccctatttcatgaagatggaaactccagttcaccgaagtgaagggctgtaccccatgacacagctagaggaggatggggactcttaacacaggctctctgctgggtgatgctgcaagttacaagnacatgtgaagccacttagctggagctgtgcctctcaaactcagtcttcccagccatggggatacagtccttgcacccaacccagggtggggtgggtgaggctcccagcggcctactctaaagccccttatctccggcctccagtgcttatcacattgggcccacagggtgaggaccctgctgtgccaggcatcctgaggccccaactctgtctcccctactcccagatcaacaccccccggaaagagggaggcttgggccccctgaacatccccctgcttgctgacgtgaccagacgcttgtctgaggattacggcgtgctgaaaacagatgagggcattgcctacaggggcctctttatcatcgatggcaagggtgtccttcgccagatcactgttaatgatttgcctgtgggacgctccgtggatgaggctctgcggctggtccaggccttccagtacacagacgagcatggggaagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtg

SEQ ID NO: 307325 - DNA, 1028 bp, Homo sapiens
gagagagagagagagagagagagagagagagagagagagagagagagagagagagagagagagagagagagccgctccgctcgtccgctccctcccccgcgccgtgcacgtcttggttcgggccgggcataaaaggcttcgcggcccaggctcacttggcgctgagaacgcgggtccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggatcaacaccccccggaaagagggaggcttgggccccctgaacatccccctgcttgctgacgtgaccagacgcttgtctgaggattacggcgtgctggtccttcgccagatcactgttaatgatttgcctgtgggacgctccgtggatgaggctctgcggctggtccaggccttccagtacacagacgagcatggggaagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtg

SEQ ID NO: 307326 - DNA, 3788 bp, Homo sapiens
  misc_feature (374)..(374): n is a, c, g, or t
  misc_feature (1434)..(1434): n is a, c, g, or t
gagagagagagagagagagagagagagagagagagagagagagagagagagagagagagagagagagagagccgctccgctcgtccgctccctcccccgcgccgtgcacgtcttggttcgggccgggcataaaaggcttcgcggcccaggctcacttggcgctgagaacgcgggtccacgcgtgtgatcgtccgtgcgtctagcctttgcccacgcagggtatgaacacccggagtgcacctggcgggaggacccccttcaggctgctttggcccgatcctgactttagtgctggccgcctttgctttccatccgctatagtggcctcctttgtccttgcgggggaaaccgaggccacagccttgcagcgcagncctgatcgcccgacttcccgccccctgctcgtgcgggcctcactgtctccttctgggctgggggcttgcgacaccgccctccggccgactcgctcgtggggtgctggtggcagtggctgggtcactcgtgctctggtcaggagagcgggtctccggcagcctccgggcctcgtagaccgggtacccgggagggtgagggttagtgctgtcgcctccgccgtgctgactcagtcatagggcccagcacgcagcgcgaccttgggttgggaggacaaagtgtcttcccgggcgcactgaccgggcgggggtctcagctttcagtcatggcctccggtaacgcgcgcatcggaaagccagcccctgacttcaaggccacagcggtggttgatggcgccttcaaagaggtgaagctgtcggactacaaaggtgagcgccgcccggagggggcccaggtagaagcggggccgtgcatgagagaagctgggccctaactcctctgtgtccctcctccccagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttgggtatgagcaggggccaaagagggaggttgcagctaagctcacaccctcaggtcctagcagtgtggcttcgtggccattgctcaacctctggaacctgcgtttccccatcgtgaaaataatggaaacattgccgcccaagtctttaaggatgatgacagtaattagcatttgacaactagttgcctggtatatagagttgcagatgcaactcagatgcaactctatctactctatgtacttagttcccaggagggaggctgtgctgccctatttcatgaagatggaaactccagttcaccgaagtgaagggctgtaccccatgacacagctagaggaggatggggactcttaacacaggctctctgctgggtgatgctgcaagttacaagnacatgtgaagccacttagctggagctgtgcctctcaaactcagtcttcccagccatggggatacagtccttgcacccaacccagggtggggtgggtgaggctcccagcggcctactctaaagccccttatctccggcctccagtgcttatcacattgggcccacagggtgaggaccctgctgtgccaggcatcctgaggccccaactctgtctcccctactcccagatcaacaccccccggaaagagggaggcttgggccccctgaacatccccctgcttgctgacgtgaccagacgcttgtctgaggattacggcgtgctgaaaacagatgagggcattgcctacaggtactgtgggaccctcagcccggctcagggagcgccctgccccccattcctgtgatgctgggaccactcctgtacaatgtcttctctgcccccagccctgtggctagcagcgggtggttggtagtcccttccttgtctctggcagtgggagctatcagctcctcactgggaaccctgatgtcttcaggggcctctttatcatcgatggcaagggtgtccttcgccagatcactgttaatgatttgcctgtgggacgctccgtggatgaggctctgcggctggtccaggccttccagtacacagacgagcatggggaagggtgagcagatacacacatgacacatgggtacatactgagcgcctccgtcactcatgcaaacattcactgcctgtcctcttacctgtccagatgggtgttagggccccaaagaagattcagctcagggctttgtctgcaggatgtttctaatgtggtaggagacaaataacgcctgacattcaaccaaggtggacaaaggggccgggctcagtggctcacggttgtattgccagcactttgggaagctgtggcaggtggatcacctgaggtcaggagttcgagaccagcctgaccaacatggtgaaaccccgtctctacgaagaacacaaaaaattagctggccgtggtggtgcacacttgtaatcccagctacttgagagactgaggcaggagttcgcttgaacccaggaggcagaggttgcagtgagctgagatcgcaccgttgtactccagcttgggcaacagagcaaaactcagtctcaaaaaaaaaaaaaattagcttggtttgtgaagcatgcctatagtcccagctactcaagaggctgaggctggaggatcacttgagcctgggaggtcaaggctgcagtaagctgtgatcgcaccactgcactccagcctgggtgacacagcaagaccctgtctcaaaaaaacaaacaaacaggccgagcgcggtggctcacgcctgtaatcccagcactttgggaggccgaggcgggcagatcatgaggtcaggagtttgagaccagcctggccaacatagtgaaaccgcgtctctgctaaaaatacaaaaaaattagctgggtgcggtggcaggtgcctgtaatcccagctacttgggaggctgaggcaggagactcccttgaacccgggaggaggttgcagtaagccgagatcacaccactgcactccagcctgggcgccagtgtgagactccatctcaaaaacaacaacaacaaaaaaacctgtaggggtggggcagagggacaaagatgggactaaaggagccaaaaagacaggaagatgctgtgtctcatgcctgtagatgctgtgtctcatgcctgtagttccacctactctggagagtgaggcagaagattgcttaggcccaggaatttgagtcgagcctaggcaacatagcaataccccatctcttttttttttttttttaagagatggggtattggttaaaaaaaaaaaaaaaaaaaaagaggccagatgcagtggctcacacctgtaatcccagcattttgggaggcctaggtgggtggatcacctgaggtcgggagttcgagacaagcttgaccgacatggagaaacccagtctctactaaaaatacaaaattagcccagcctggtggtgcatgcctgtaatcccagctacttgggaggctgaggcaagagaatcgtttgaagctgagaggcggaggttgcagtgagctgagatcgtgccattgcactccagcctgggcaacgagtgaagcgaaactccgtctcaaaaaataaaaaaaaaaaagaggccgggcacggtggctcatgcctgtaatcccaccactttgggaggctgaggcgggcggatcaagaggtcaggagatcgagaccatcctagctaacgcggtgaaaccctgtctctactaaaaatacaaaaaaattagtcgggcgtggtggcgggcgcctgtagtcccagcta

SEQ ID NO: 307327 - DNA, 830 bp, Homo sapiens
agggaagaggaaggaggccgcggcttcgcgtcccgcctctcgcctggctggccgtggggggcctggacgcagtggcctcccgaatctcccaggaccctaatatcgcccgaggatgctgggaggaacgctgagccgacctctccgttaggctgaagattgcacaaaccatgctaatggccagcatggatggagggagcgtgtgagatgtgtggggcagcgtgctgcatctcagccaactccaggagccagttgatgtgatggactaccttaattgatttttgaatgttgagccagccttatgcatgtgggataaacccctgttgatcatggctggctggagtgcagtggtgcaatcatggctcactgcaacctcaaattcctgggctcaagggatcctcctgcctcagcctcccgagtagctgggactacaggtgtgtgccaccactcccagctgatttttttattttttgtggggacgagatctaactttgttgcccaggctggtattgagctcttgggttcaagtaatcctcctgcctcagtctcctaaagtgctagggttatagatgtgagccactgtacccagccaggttgtatattgaaataataatttcttaatatattgaattaaaatatatttaaggcaattttatctgtttctttttactttttaaatgtggttactggataatttgaaattatatatatgactgtcatatataagacaaaggaaatgtaagagatttcctttggacaacactattctcaagggtacttgggaaaggtttccagagcttaaaagacggagaaataaagtcagatagaaggat

SEQ ID NO: 307328 - DNA, 2309 bp, Homo sapiens
agggaagaggaaggaggccgcggcttcgcgtcccgcctctcgcctggctggccgtggggggcctggacgcagtggcctcccgaatctcccaggaccctaatatcgcccgaggatgctgggaggaacgctgagccgacctctccgttaggctgaagattgcacaaaccatgctaatggccagcatggatggagggagcgtgtgagatgtgtggggcagcgtgctgcatctcagccaactccaggagccagttgatgtgatggactaccttaattgatttttgaatgttgagccagccttatgcatgtgggataaacccctgttgatcatggctggctggagtgcagtggtgcaatcatggctcactgcaacctcaaattcctgggctcaagggatcctcctgcctcagcctcccgagtagctgggactacagttcctgctggaatcttgctgttgcccattcaagtctggtggttcctgtgtgttggggtggccttgcttctcctgctcttagctctggaggagccctcggctggtgctgcagtgaatctgtcagagtcgtcctaaccagagtgcccccatcctgaatagaggctggataaagccaaacctgctgggttatagtcccaggggattgggcagtcctggtcacaagatatttaaggttgagggaataagttaatgatgctaagtaaataaagaccctgaattctttcccgtgagagattcaagaactcactcttggcatctgggataagaccctttttccggtaacaaacccctgccctggccctttcttccttctggaaaacttaaaaaaaaaataggcctcaaaaagactgcattaatctgagaaactgctgaatatggctactaagagaagctgggattttctgatttttaatgtcggtttcaaagagagcaggtatactttgcaggagggaaccatgctagctgcagaatcatggacgagctggaccacaagtttttacacagtgtgcatgcttttgttctcctgtcaacttctgttgttttcctgtcaacttctgttgttttcatcaaaagccatcaacccgcctcagccagggcatcataatgtacatgcaacagagtgttccaagaaactttcagctgagaccctaagaccctggacatgcaatgccagagtgaagtgtgaggaccacagctgtgcaggacatgcagaaaggaggggcagagagccaatgagatgatgtcccacgactcacctgtgtcagtggagaccgaaggagacttggagggtgcttttggagagaactgctgatgttttgtgagcctcactctctctgtgtgtggaaatgctggaggatgaaaccgtctaaactctcctgaagtcccgggaatggagttttaatggtaatgtgtgatgggatgtgtgttctcttatggtatgggagacacagaggactcacagaggactggcctctgcctcttgaccagggatcaggagagatgggaactgagctggtcagctgctcttcagagctggtcgaggagagatttctgctgtgctgggagggcctaaaaacatgcatggatggagcccaaggaccaggtgcagatcttatgcaagaatgaaccagggggtgacttaggtccaccaaaagactgcccagagggacaaaaggctatcagtgaaaagaatccacagatgaactgccagttcctcagggctgaggcaagatcttaattttgagtaggagcagagtgtattacctacaacaaggataccacagatgagaaaaccctagttttaaacctgctacatccaaagagagcaatgcaactctggcagtagcaaaaatgttgtgcctctcctttcctcactcctaatttcccatcccagagaagggtcagaaaccatcttctgcaagatgggaggaagggtagcagccagactgcaaaaagggagaagaaaccagctacctcttgctgttctcagtggcagactccccacctgcaacaggtcaggtctgttactggagagaaaagacaggacatttttaaattctaggtatagagcaataaaagaagaattcaaacaaagggatcaggaagaggattgctactaagaggcagagaaaccaatgaagccttttgccatctcacactggaaagacaaaaagtcatagaggcttgatttttataaggaaagagaagtgagaaactgacctcgatactttgttggacttgcctaaagacatttgctgaattctcgggctgtgctgggatggagattagaggccaaataaaaacctctggtaagtagtgc

SEQ ID NO: 307329 - DNA, 1365 bp, Homo sapiens
  misc_feature (346)..(346): n is a, c, g, or t
  misc_feature (443)..(443): n is a, c, g, or t
  misc_feature (543)..(543): n is a, c, g, or t
  misc_feature (561)..(561): n is a, c, g, or t
  misc_feature (605)..(605): n is a, c, g, or t
  misc_feature (670)..(670): n is a, c, g, or t
  misc_feature (956)..(956): n is a, c, g, or t
agggaagaggaaggaggccgcggcttcgcgtcccgcctctcgcctggctggccgtggggggcctggacgcagtggcctcccgaatctcccaggaccctaatatcgcccgaggatgctgggaggaacgctgagccgacctctccgttaggctgaagattgcacaaaccatgctaatggccagcatggatggagggagcgtgtgagatgtgtggggcagcgtgctgcatctcagccaactccaggagccagttgatgtgatggactaccttaattgatttttgaatgttgagccagccttatgcatgtgggataaacccctgttgatcatgatggaacgaagtctgtntgtggaaacacccttcccctctgtttacttggacctgattttgaaagtaacaagtcactttatttgggctggaggaaaaagcactaaaccagatgtngaggtgaccgggattcctggaagacattcttctctccaacgagacacatgatgcatgaagtaggagcccctggcaaggagcccaggctgccatggctcgntcgctcctgcttcccggnatggccccgaggctagctgctctgtactgctgagcatcgtcccntggcgtgtcaccagactacccactactgtgcttgccctgcggtgggcggttcagtcgttgcaggntgaagtccctgtacaggagtccatacgcacggagttacccaatgggccaggcacaggaggatggccatggcaaaaccggagatacaatgaagaccaaatgaccggaggagagagacacagcaggcaggacacaaggcatgcgaattaaagagcacatgttaccaacaggaacagcgaaaaccgagacacacaggactgcgggagagacgagaacacagcgagaggaaaacagagagaacacggcacagtcgtacatctgcggttgccacccgcatcgagcgatccnagctcacgcaaacaagcagacaggagacggagcgagccaggacgaacgaacagaggacgcaggaagaagagagggagcgcgaagcggcacagaagtaggacagtgcgacaagcaggaagagcgcgcgagagcggacgtgacgcgaacacggagacagagacaggacagaagacgagagagtgagcacagacgggaggaacgaagaaggcgagagcggcagagggagagaaaacagaaaaaggagagagagagagcgacaacaaacgcaggagacggagagcggcgagacgcacaaagggaagaagcgccgacgagacgaagagaggagcagcagacgagggcaggcagaagacgggcacagaccgagaagaagacaggaggagggaggaacggacagaagaggcaaacg

SEQ ID NO: 307330 - DNA, 1084 bp, Homo sapiens
agggaagaggaaggaggccgcggcttcgcgtcccgcctctcgcctggctggccgtggggggcctggacgcagtggcctcccgaatctcccaggaccctaatatcgcccgaggatgctgggaggaacgctgagccgacctctccgttaggctgaagattgcacaaaccatgctaatggccagcatggatggagggagcgtgtgagatgtgtggggcagcgtgctgcatctcagccaactccaggagccagttgatgtgatggactaccttaattgatttttgaatgttgagccagccttatgcatgtgggataaacccctgttgatcatggctggctggagtgcagtggtgcaatcatggctcactgcaacctcaaattcctgggctcaagggatcctcctgcctcagcctcccgagtagctgggactacagctttccaaagagctgtccaaaatgccccctgccccctgcttttccacagaggaaccccagccatctcagtgtgtgttctccctcacccagctgacctggccgaaggctgttctaggtgccaagaggacccttctctcatcgtggggagcactcggggatggttgcgtttcctgcctcatcccattactgaggcttgtactcatctccctccggggcactctcttacccgagttgagatacctctgcaactgaggggttgactccatgtcatttcaaaatgggaactttccaggctcacatttgtcaccaactgttcatggatggtcataagaaactactaaaccctattccagttacgtggccgaccaaaaacgcagcacctgcacgaactaacacagacagcgacagccacaacaaaagacaagacctccagaagaacagacacacacaacacgcgcggcgcgcacaaatagtcaaccgcggacgcatcaaagcgcagccgcaataggaacagccgacccgaaagcagagaaaaaaaacagagaggggtaagaaaccaggagaaacacacggactgaggagccacctctcgcgggatacgtagcacccgacgacggcgaggacaacaagagaggcgcacgcgccgagagcaa

SEQ ID NO: 307331 - DNA, 363 bp, Homo sapiens
gtccaactgcactagctaggactgctagtatgatgttgaaaaagagtggcaagagggatcacccttgtcttgttgctaatcttagccagaaagcttctaatttctcactattaagcatggtattaactgtagggctttaaacagatatattatttagcaggtttaggaagctcccctctattcttagtaggctgagtgtttttatcataaacaggcagtggattttgtcaaatgtcttttctgtgtatattgataagatcatatgattttcttttttagccagttgatgtgatggactaccttaattgatttttgaatgttgagccagccttatgcatgtgggataaacccctgttgatcatg

SEQ ID NO: 307332 - DNA, 1006 bp, Homo sapiens
ttaatataaaattttgaaagatgtaaggctatggaaaaacatagtaaaaaattattcaagaatattttgtaatgcatgaaagcttttgaaaggctaattttatctttagttgtataaatatattttggaagagaataagattttaatatgtgtatctacattatctgtgtctttcactaataagacaaggttcaacatctgtcttcagattgcattttctgtgggaagaacttaggttgtaggcatttagctcagagaaaggggaaaaggtactttcactgctcactttttgctatttctgccccaagacctactgttcattctccagacttgctgtattttatgtcgaaaggttttactgtttccatgaggaactgtggttcattttccccaggcttataatcagtaagtagtgattttcttttcagtgttacttactgtgatactgtaaaatcaaactaacaataaggtgccacaacgccataaaaaattaataatattgggaagatgttgattcccaaactaagatttgggctttggttttgaactgttaatttgttcattcattttaatatttcctttgactgtctcagatataccaaagcgtggtgcattgtggaatgtgtgccagtctcaatgcatgtagctctgtaggatggaaagtcagttatgaagagagacttctttttcttctgtgtcctgttgattaagaagaatctgtatggccgggcacggtggctcacgcctgtaatcccagcactttggaaggctgaggggggtggatcacgaggtcaggagttcaagatgaacttggccaagatagtgaaaccctgtctctactaaaaataaaaaaaaaaattagccgggcgtggtggtgggcgcctgtaatctcagctacttgggaggctgagacagagaattgcttgaacccaggaggcggaggttgcagtgagcctagatcgtgccactgcgctccagcctgggcgacagagagagactccatctc

SEQ ID NO: 307333 - DNA, 390 bp, Homo sapiens
gccacgtgtggtgctgtgtgcctatagtcccagctgcttaggaggctgagatgggaggattgcttgagccaaggaggttgatgctgcagagctgagattgtaccactgcattccggcctgggcaacagagcaagaccctgtctcaaagaaatctggacttaatataaaattttgaaagatgtaaggctatggaaaaacatagtaaaaaattattcaagaatattttgtaatgcatgaaagcttttgaaaggctaattttatctttagttgtataaatatattttggaagagaataagattttaatatgtgtatctacattatctgtgtctttcactaataagacaaggttcaacatctgtcttcagattgcattttctgtgggaagaact

SEQ ID NO: 307334 - DNA, 375 bp, Homo sapiens
tggtattaaatttgtgagtcattgaaattaatccctgactgaattggaaaggaattgtatttgcagtatttggatttatttatttttcaggtatggaattctggtgattttgaaaacatgaatgataccattttgcagcagcattgtagatttgtagtattttagattggtatcacagtgcacctgaaaagtaagtttcattttacttttttttattgttgttgagacggagtctcactttgtcacccaggctggagtgcagtggtgtgatcttggctcatggcagcctctgcctcgctggttcaagcgattctcctgcctcagcctcccgagtagctaggactatagatgctcgccaccatgcccagctaattt

SEQ ID NO: 307335 - DNA, 1818 bp, Homo sapiens
aacaaagcaaaacaaaccttgggaaactaaggccatttgttttgttttggtgtcccctttgaagccctgccttctggccttactcctgtacagatatttttgacctataggtgcctttatgagaattgagggtctgacatcctgccccaaggagtagctaaagtaattgctagtgttttcagggattttaacatcagactggaatgaatgaatgaaactttttgtcctttttttttctgtttttttttttctaatgtagtaaggactaaggaaaacctttggtgaagacaatcatttctctctgttgatgtggatacttttcacaccgtttatttaaatgctttctcaataggttccagagccagtgttcttgttcaacctgaaagtaatggctctgggttgggccagacagttgcactctctagtttgccctctgccacaaatttgatgtgtgacctttgggcaagtcatttatcttctctgggccttagttgcctcatctgtaaaatgagggagttggagtagattaattattccagctctgaaattctaagtgaccttggctaccttgcagcagttttggatttcttccttatctttgttctgctgtttgagggggctttttacttatttccatgttattcaaaggagactaggcttgatattttattactgttcttttatggacaaaaggttacatagtatgcccttaagacttaattttaaccaaaggcctagcaccaccttaggggctgcaataaacacttaacgcgcgtgcgcacgcacacacacacacacacacacacacacaggtcagagtttaaggctttcgagtcatgacattctagcttttgaattgcgtgcacacacacacgcacgcacacactctggtcagagtttattaaggctttcgagtcatgacattatagcttttgagttggtgtgtgtgacaccaccctcctaagtggtgtgtgcttgtaattttttttttcagtgaaaatggattgaaaacctgttgttaatgcttagtgatattatgctcaaaacaaggaaattcccttgaaccgtgtcaattaaactggtttatatgactcaagaaaacaataccagtagatgattattaactttattcttggctctttttaggtccattttgattaagtgacttttggctggatcattcagagctctcttctagcctacccttggatgagtacaattaatgaaattcatattttcaaggacctgggagccttccttggggctgggttgagggtggggggttggggagtcctggtagaggccagctttgtggtagctggagaggaagggatgaaaccagctgctgttgcaaaggctgcttgtcattgatagaaggactcacgggcttggattgattaagactaaacatggagttggcaaactttcttcaagtattgagttctgttcaatgcattggacatgtgatttaagggaaaagtgtgaatgcttatagatgatgaaaacctggtgggctgcagagcccagtttagaagaagtgagttgggggttggggacagatttggtggtggtatttcccaactgtttcctcccctaaattcagaggaatgcagctatgccagaagccagagaagagccactcgtagcttctgctttggggacaactggtcagttgaaagtcccaggagttcctttgtggctttctgtatacttttgcctggttaaagtctgtggctaaaaaatagtcgaacctttcttgagaactctgtaacaaagtatgtttttgattaaaagagaaagccaactaaaaaaaaatgt

SEQ ID NO: 307336 - DNA, 1833 bp, Homo sapiens
aacaaagcaaaacaaaccttgggaaactaaggccatttgttttgttttggtgtcccctttgaagccctgccttctggccttactcctgtacagatatttttgacctataggtgcctttatgagaattgagggtctgacatcctgccccaaggagtagctaaagtaattgctagtgttttcagggattttaacatcagactggaatgaatgaatgaaactttttgtcctttttttttctgtttttttttttctaatgtagtaaggactaaggaaaacctttggtgaagacaatcatttctctctgttgatgtggatacttttcacaccgtttatttaaatgctttctcaataggttccagagccagtgttcttgttcaacctgaaagtaatggctctgggttgggccagacagttgcactctctagtttgccctctgccacaaatttgatgtgtgacctttgggcaagtcatttatcttctctgggccttagttgcctcatctgtaaaatgagggagttggagtagattaattattccagctctgaaattctaagtgaccttggctaccttgcagcagttttggatttcttccttatctttgttctgctgtttgagggggctttttacttatttccatgttattcaaaggagactaggcttgatattttattactgttcttttatggacaaaaggttacatagtatgcccttaagacttaattttaaccaaaggcctagcaccaccttaggggctgcaataaacacttaacgcgcgtgcgcacgcgcgcgccgcacacacacacacacacacacacacacacacacaggtcagagtttaaggctttcgagtcatgacattctagcttttgaattgcgtgcacacacacacgcacgcacacactctggtcagagtttattaaggctttcgagtcatgacattatagcttttgagttggtgtgtgtgacaccaccctcctaagtggtgtgtgcttgtaattttttttttcagtgaaaatggattgaaaacctgttgttaatgcttagtgatattatgctcaaaacaaggaaattcccttgaaccgtgtcaattaaactggtttatatgactcaagaaaacaataccagtagatgattattaactttattcttggctctttttaggtccattttgattaagtgacttttggctggatcattcagagctctcttctagcctacccttggatgagtacaattaatgaaattcatattttcaaggacctgggagccttccttggggctgggttgagggtggggggttggggagtcctggtagaggccagctttgtggtagctggagaggaagggatgaaaccagctgctgttgcaaaggctgcttgtcattgatagaaggactcacgggcttggattgattaagactaaacatggagttggcaaactttcttcaagtattgagttctgttcaatgcattggacatgtgatttaagggaaaagtgtgaatgcttatagatgatgaaaacctggtgggctgcagagcccagtttagaagaagtgagttgggggttggggacagatttggtggtggtatttcccaactgtttcctcccctaaattcagaggaatgcagctatgccagaagccagagaagagccactcgtagcttctgctttggggacaactggtcagttgaaagtcccaggagttcctttgtggctttctgtatacttttgcctggttaaagtctgtggctaaaaaatagtcgaacctttcttgagaactctgtaacaaagtatgtttttgattaaaagagaaagccaactaaaaaaaaatgt

SEQ ID NO: 307337 - DNA, 1814 bp, Homo sapiens
aacaaagcaaaacaaaccttgggaaactaaggccatttgttttgttttggtgtcccctttgaagccctgccttctggccttactcctgtacagatatttttgacctataggtgcctttatgagaattgagggtctgacatcctgccccaaggagtagctaaagtaattgctagtgttttcagggattttaacatcagactggaatgaatgaatgaaactttttgtcctttttttttctgtttttttttttctaatgtagtaaggactaaggaaaacctttggtgaagacaatcatttctctctgttgatgtggatacttttcacaccgtttatttaaatgctttctcaataggttccagagccagtgttcttgttcaacctgaaagtaatggctctgggttgggccagacagttgcactctctagtttgccctctgccacaaatttgatgtgtgacctttgggcaagtcatttatcttctctgggccttagttgcctcatctgtaaaatgagggagttggagtagattaattattccagctctgaaattctaagtgaccttggctaccttgcagcagttttggatttcttccttatctttgttctgctgtttgagggggctttttacttatttccatgttattcaaaggagactaggcttgatattttattactgttcttttatggacaaaaggttacatagtatgcccttaagacttaattttaaccaaaggcctagcaccaccttaggggctgcaataaacacttaacgcgcgtgcgcacgcgcgcgccgcacacacacacacacacacacacacacacacacaggtcagagtttaaggctttcgagtcatgacattctagcttttgaattgcgtgcacacacacacgcacgcacacactctggtcagagtttattaaggctttcgagtcatgacattatagcttttgagttggtgtgtgtgacaccaccctcctaagtggtgtgtgcttgtaattttttttttcagtgaaaatggattgaaaacctgttgttaatgcttagtgatattatgctcaaaacaaggaaattcccttgaaccgtgtcaattaaactggtttatatgactcaagaaaacaataccagtagatgattattaactttattcttggctctttttaggtccattttgattaagtgacttttggctggatcattcagagctctcttctagcctacccttggatgagtacaattaatgaaattcatattttcaaggacctgggagccttccttggggctgggttgagggtggggggttggggagtcctggtagaggccagctttgtggtagctggagaggaagggatgaaaccagctgctgttgcaaaggctgcttgtcattgatagaaggactcacgggcttggattgattaagactaaacatggagttggcaaactttcttcaagtattgagttctgttcaatgcattggacatgtgatttaagggaaaagtgtgaatgcttatagatgatgaaaacctggtggaagaagtgagttgggggttggggacagatttggtggtggtatttcccaactgtttcctcccctaaattcagaggaatgcagctatgccagaagccagagaagagccactcgtagcttctgctttggggacaactggtcagttgaaagtcccaggagttcctttgtggctttctgtatacttttgcctggttaaagtctgtggctaaaaaatagtcgaacctttcttgagaactctgtaacaaagtatgtttttgattaaaagagaaagccaactaaaaaaaaatgt

SEQ ID NO: 307338 - DNA, 4051 bp, Homo sapiens
ggcagagggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcaaaaaaaaaaaaaaaaaactcgagactagttctctctctctcctcgaacgctgacgttggctcctgagccgggcgctgcctcgcgcctgattggcgggtcctcggggccgccctccccagcgcaccacccctgggttccctcccgggtccgcagtggaaacactgccctctcccttcttgacccctagcccttccttccctccctccttccctcctgtcgccgtctcttctggcgccgctgctcccggaggagctcccggcacggcgatgggttctcgggcctccacgttactgcgggacgaagagctcgaggagatcaagaaggagaccggcttttcccacagtcaaatcactcgcctctacagccggttcaccagcctggacaaaggagagaatgggactctcagccgggaagatttccagaggattccagaacttgccatcaacccactgggggaccggatcatcaatgccttctttccagagggagaggaccaggtaaacttccgtggattcatgcgaactttggctcatttccgccccattgaggataatgaaaagagcaaagatgtgaatggacccgaaccactcaacagccgaagcaacaaactgcactttgcttttcgactatatgatttggataaagatgaaaagatctcccgtgatgagctgttacaggtgctacgcatgatggtcggagtaaatatctcagatgagcagctgggcagcatcgcagacaggaccattcaggaggctgatcaggatggggacagtgccatatctttcacagaatttgttaaggttttggagaaggtggatgtagaacagaaaatgagcatccgatttcttcactaaaggagaccaaactgttccttgcggtctagtatttaagaactggaacttgaaagtcctccttctaccaactccacctccaccccctcattccccttctcccaaagtactactgctgttgcatgacaaccccaaatatgttctgtcaacacaaacctgcctttggtgtataaacagggcattacagaatggtacaccctatatatttctgttcagtatccattcactagttcttcatttataaatatcatcttccccattctgctgctgaatgccacacatccatccagtctgagaaagtgagagaggcaatcatgccaagaacaagccagcaaagctctttcaccagatgtagactgtagccctgctgccttccctccagcgagtctgccagcatgcttcttcatcctttttatatgttctttgcttcctacttccctgtcttccaacatactgttcacttactctggcagtctttctgcttttcattaagcctcaaaatctcctctgttctacttggcaccacaagctatgtcctatatatgtatttctgacttggcaggatagttcaggggtctggcagtttttatttaccttcattattaaatgggcctctgggatgttgcctcttcaggagctttttggtaatcaatacttctctcagaagtatgagaccatcctctgcactctgctctgtcatcaaaggctgctgggtggagataccctttttgaaaggtggccttggtgagaggtatggagccaagtcttctaggttgcttgcccacatcactctatctctggcctctgattctcaactttgtacctgtgtggctcctcttgttagtgcaatgttgactgttgaaaaagcagcagtatgcttacaggtttgcttagtttggggacaccgttaccaccagaatggctgctctgacaatatgcctagggactttctcatggcttttatttaataaggaggctgggcaccctataaagcctcatgcattcacacctttgcagcatggtttatgcctcagtgttatgtgcactggaatgttttccacttcacatttccaagtagaaatattagtgttacggaagtgcctaatatcccagtccaaattttttttttttttttttttttttttttgagacagagtcttgctctgtcacccaggctggagtgcagtggtgcgatcgctcactgcaacctcagcctcctggatttaagtgattctcctgcctcagcctcccaagtagctgggattacaggtgtgcaccaccatgcccggctaattttttgtatttttagtggagacagggtttcaccatgttggccaggctggtctcgaactcctgacctcgtgatccgcctgcctcagcctcccaaagtgctgggattacaggtgtgagccaccacgcctggccccagtccaaaatatttaaagattgtttccttagtgtcttgaagttttgcacaaaattcttttttttgagatggagtctcactctgtcacccaggctggagtgcagtggcgtgatcttggctcactgcaacctctgcctcctgggttcaagcaattctcccacctcagcctcccaagtagctgggattacagacgtgtgccaccatacctgggtaatttttgcatttttagtggagagggagtttcaccatgttggccaggttggtcttgaactcctgacctcaggtgatcctcctgcctcggcctcccaaagtgctgggattacaggcatgagccaccgtgctcagccgcaaaattctttatgaattttacacttggcaaatgttaatgacggaagccatagtctgctcctaatacatgtccaaagcattgactgttgtgtcattagctgcctggttacattagctccctggcttcttgtttagaccactgctaatcccttaaaaacaagaggtctggcactagtagcacaacctaaggtggcattacagatctttgagcgagccacagcaacttttctgccaagtcagcttagtttagacttcagtgaatcaggctattgctatcctaatgtatgtctctatgagtgtatttagccacacatctgcccttggttgactttctgactcattgcttgcttgcttgtttccttgctttggaaaactattgaagattgctaaaaaataccactgcaaagtgatggaaaagggtggagaacaggggagtagccaggctggatggctcaaatataaatgaatgaggaattctttatgaagtatcagtcagattttatgattaagtgatgtaatataggaattatgtaaaagggaagaatgtctgatactgatctattagagaggtactttagaggcttcttgattggcataaagttcctaaggttatagattttccccccttttggctgtatagcaaagtgttttaatccacggttgtgccttattgttccattaaaattgtatcttcgatccatcaataaatacttgtggttgaaacaaaa

SEQ ID NO: 307339 - DNA, 3113 bp, Homo sapiens
atcaagggaccgcagggccggctctgctttcccagcacgctgcctcaccaagaaagaatccagagaaggactggtggacttggaatgttaagtcatggcccatttgatgatgttcagggatgtggctgtagatttctctcaggaggagtgggagtgcctggacctggaacagagggatttatatagagatgtgatgttggagaactacagcacatggtctcactgggtttttgcatttatcagccagaagcgttctctttattggagaaagggaaagagccctggaagattttgagggatgagacaagaggaccttgcccagacatgcagtcgaggtgtcagaccaagaagttattaccaaaaaatggcatttttgagagagaaatagcccaattggaaataatgagaatttgtaaaaaccacagccttgactgtttatgttttagaggtgactgggaaggcaacactcagtttcaaacacttcaagataatcaagaggaatgcttcaagcaggtgatacgcacctgtgaaaaaaggcccacttttaaccagcatacagtgtttaatctacaccagagacttaatacaggagacaaactgaatgaatttaaagaactggggaaagcctttatttctggttcagatcatactcaacatcagttaattcacacaagtgagaaattctgtggagataaagaatgtgggaatacctttcttcctgattcagaagttattcaatatcagacagttcacactgttaagaaaacatatgaatgtaaagaatgtgggaagtcttttagtttacgttcgagtcttactggtcataagagaattcataccggtgagaagccttttaaatgtaaggattgtgggaaagcctttagatttcattcacaacttagtgtccataagcgaattcatactggtgagaaatcttatgaatgtaaggaatgtgggaaggcctttagttgtggctcagatcttactcgacatcagagaattcatactggtgaaaaaccctatgaatgtaatgaatgtagaaaggcctttagtcagcgatcacatcttattaaacatcagagaattcacactggtgaaaaaccttatgaatgtaaggagtgtgggaaagcttttactcgtggatcacacctaactcagcatcagagaattcatactggtgagaaatctcatgagtgtaaggaatgtggaaaagcctttattcgtggttcaaatcttgctcaacatcagaatgttcatgttggtaggaaaccttataaatgtgagaaatgtgggaaagcctatatttggagctcacaccttgctcgacatcagcgaattcatactggcaggaaaccttatgaatgtaagcaatgcgggaagacttttacttgggcttcgtatcttgctcaacatgagaaaattcacaatgagaggaaatcctatgaatgtaaggaatgtggaaagacctttcttcatggctcagagtttaatcgacatcagaaaattcatactggtgagagaaactatgaatgtaaggaatgtggaaagaccttttttcgtggttcagaacttaatcgacaccagaaaattcatactggaaagaggccatatgaatgtgaagaatgtggaaaagcctttctctggggttcacaacttactcgacatcagagaatgcatactggtgaggaaccttacgtatgtaaagaatgtgggaaatcttttatctggggttcacagcttacacgacataagaaaattcatactgatgcagaaccttatggatgcaagaaaagtagccacatctttagtcaccattcatattttactgaacaaaaaattcataatagtgcaaatctctgtgaatggacagactatgggaacacctttagtcatgagtcaaactttgctcaacaccagaatatttacacttttgagaaatcctatgaatttaaagattttgagaaagcattttcttcaagctctcacttcatttcactcttgtgaaatattatataaaagtgtaggaagggctttattcatgactcattaattgatgtcatttatttttttctcttgaggaacaccacaaatgtaagtaatattggaaggcattttaacagagcacacatccagcagcagcagcagcagcagcagagaattcatcatgcaatcaatataggaaagaaattactgatcagttatcaattgcagaatatcagggtaaaattttatgagatagcatgaattctttttgaatcattctcaaaacattctcatcagagatgttgcataaagaatttatatataatcctgacctcaggtgatcctcctgcctcggcctcccaaagtgctgggattacaggcatgagccaccgtgctcagccgcaaaattctttatgaattttacacttggcaaatgttaatgacggaagccatagtctgctcctaatacatgtccaaagcattgactgttgtgtcattagctgcctggttacattagctccctggcttcttgtttagaccactgctaatcccttaaaaacaagaggtctggcactagtagcacaacctaaggtggcattacagatctttgagcgagccacagcaacttttctgccaagtcagcttagtttagacttcagtgaatcaggctattgctatcctaatgtatgtctctatgagtgtatttagccacacatctgcccttggttgactttctgactcattgcttgcttgcttgtttccttgctttggaaaactattgaagattgctaaaaaataccactgcaaagtgatggaaaagggtggagaacaggggagtagccaggctggatggctcaaatataaatgaatgaggaattctttatgaagtatcagtcagattttatgattaagtgatgtaatataggaattatgtaaaagggaagaatgtctgatactgatctattagagaggtactttagaggcttcttgattggcataaagttcctaaggttatagattttccccccttttggctgtatagcaaagtgttttaatccacggttgtgccttattgttccattaaaattgtatcttcgatccatcaataaatacttgtggttgaaacaaaa

SEQ ID NO: 307340 - DNA, 400 bp, Homo sapiens
gcacgagtagcaatcttcaatagttttccaaagcaaggaaacaagcaagcaagcattgctaaaaaataccactgcaaagtgatggaaaagggtggagaacaggggagtagccaggctggatggctcaaatataaatgaatgaggaattctttatgaagtatcagtcagattttatgattaagtgatgtaatataggaattatgtaaaagggaagaatgtctgatactgatctattagagaggtactttagaggcttcttgattggcataaagttcctaaggttatagattttccccccttttggctgtatagcaaagtgttttaatccacggttgtgccttattgttccattaaaattgtatcttcgatccatcaataaatacttgtggttgaaacaaaa

SEQ ID NO: 307341 - DNA, 675 bp, Homo sapiens
aattcactggaatgtggcgtaatcaaatctggctccttccacttctgagttggtgcaagaaacacttggcagctattaaagtgctattctttgcagttatttggtataatttgccacagaagtaaattccaggagccgggaagatttccagaggattccagaacttgccatcaacccactgggggaccggatcatcaatgccttctttccagagggagaggaccaggtaaacttccgtggattcatgcgaactttggctcatttccgccccattgaggataatgaaaagagcaaagatgtgaatggacccgaaccactcaacagccgaagcaacaaactgcactttgcttttcgactatatgatttggataaagatgaaaagatctcccgtgatgagctgttacagtagagacggggtttcagcatattggccaggctggtctcgaactcctaacctcaagtgatccacccacctcggcctcccaaagtgctgggagtacaagcacgagccatcatgcctggccccaactgtccattttaaatatgtacagcttattgtatattatttatacttcaataaagatagttactcgggaggctgaggcaggagaatggtgtgaacctaggaggcggagcttgcagtgagccgagatcacgctactgcactccagcctg

SEQ ID NO: 307342 - DNA, 3268 bp, Homo sapiens
gaattccgggcaaagctctttcaccagatgtagactgtagccctgctgccttccctccagcgagtctgccagcatgcttcttcatcctttttatatgttctttgcttccttccctccctccttccctcctgtcgccgtctcttctggcgccgctgctcccggaggagctcccggcacggcgatgggttctcgggcctccacgttactgcgggacgaagagctcgaggagatcaagaaggagaccggcttttcccacagtcaaatcactcgcctctacagccggttcaccagcctggacaaaggagagaatgggactctcagccgggaagatttccagaggattccagaacttgccatcaacccactgggggaccggatcatcaatgccttctttccagagggagaggaccaggtaaacttccgtggattcatgcgaactttggctcatttccgccccattgaggataatgaaaagagcaaagatgtgaatggacccgaaccactcaacagccgaagcaacaaactgcactttgcttttcgactatatgatttggataaagatgaaaagatctcccgtgatgagctgttacaggtgctacgcatgatggtcggagtaaatatctcagatgagcagctgggcagcatcgcagacaggaccattcaggaggctgatcaggatggggacagtgccatatctttcacagaatttgttaaggttttggagaaggtggatgtagaacagaaaatgagcatccgatttcttcactaaaggagaccaaactgttccttgcggtctagtatttaagaactggaacttgaaagtcctccttctaccaactccacctccaccccctcattccccttctcccaaagtactactgctgttgcatgacaaccccaaatatgttctgtcaacacaaacctgcctttggtgtataaacagggcattacagaatggtacaccctatatatttctgttcagtatccattcactagttcttcatttataaatatcatcttccccattctgctgctgaatgccacacatccatccagtctgagaaagtgagagaggcaatcatgccaagaacaagccagcaaagctctttcaccagatgtagactgtagccctgctgccttccctccagcgagtctgccagcatgcttcttcatcctttttatatgttctttgcttcctacttccctgtcttccaacatactgttcacttactctggcagtctttctgcttttcattaagcctcaaaatctcctctgttctacttggcaccacaagctatgtcctatatatgtatttctgacttggcaggatagttcaggggtctggcagtttttatttaccttcattattaaatgggcctctgggatgttgcctcttcaggagctttttggtaatcaatacttctctcagaagtatgagaccatcctctgcactctgctctgtcatcaaaggctgctgggtggagataccctttttgaaaggtggccttggtgagaggtatggagccaagtcttctaggttgcttgcccacatcactctatctctggcctctgattctcaactttgtacctgtgtggctcctcttgttagtgcaatgttgactgttgaaaaagcagcagtatgcttacaggtttgcttagtttggggacaccgttaccaccagaatggctgctctgacaatatgcctagggactttctcatggcttttatttaataaggaggctgggcaccctataaagcctcatgcattcacacctttgcagcatggtttatgcctcagtgttatgtgcactggaatgttttccacttcacatttccaagtagaaatattagtgttacggaagtgcctaatatcccagtccaaattttttttttttttttttttttttttttgagacagagtcttgctctgtcacccaggctggagtgcagtggtgcgatcgctcactgcaacctcagcctcctggatttaagtgattctcctgcctcagcctcccaagtagctgggattacaggtgtgcaccaccatgcccggctaattttttgtatttttagtggagacagggtttcaccatgttggccaggctggtctcgaactcctgacctcgtgatccgcctgcctcagcctcccaaagtgctgggattacaggtgtgagccaccacgcctggccccagtccaaaatatttaaagattgtttccttagtgtcttgaagttttgcacaaaattcttttttttgagatggagtctcactctgtcacccaggctggagtgcagtggcgtgatcttggctcactgcaacctctgcctcctgggttcaagcaattctcccacctcagcctcccaagtagctgggattacagacgtgtgccaccatacctgggtaatttttgcatttttagtggagagggagtttcaccatgttggccaggttggtcttgaactcctgacctcaggtgatcctcctgcctcggcctcccaaagtgctgggattacaggcatgagccaccgtgctcagccgcaaaattctttatgaattttacacttggcaaatgttaatgacggaagccatagtctgctcctaatacatgtccaaagcattgactgttgtgtcattagctgcctggttacattagctccctggcttcttgtttagaccactgctaatcccttaaaaacaagaggtctggcactagtagcacaacctaaggtggcattacagatctttgagcgagccacagcaacttttctgccaagtcagcttagtttagacttcagtgaatcaggctattgctatcctaatgtatgtctctatgagtgtatttagccacacatctgcccttggttgactttctgactcattgcttgcttgcttgtttccttgctttggaaaactattgaagattgctaaaaaataccactgcaaagtgatggaaaagggtggagaacaggggagtagccaggctggatggctcaaatataaatgaatgaggaattctttatgaagtatcagtcagattttatgattaagtgatgtaatataggaattatgtaaaagggaagaatgtctgatactgatctattagagaggtactttagaggcttcttgattggcataaagttcctaaggttatagattttccccccttttggctgtatagcaaagtgttttaatccacggttgtgccttattgttccattaaaattgtatcttcgatccatcaataaatacttgtggttgaaacaaaa

SEQ ID NO: 307343 - DNA, 3978 bp, Homo sapiens
ggcagagggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcaaaaaaaaaaaaaaaaaactcgagactagttctctctctctcctcgaacgctgacgttggctcctgagccgggcgctgcctcgcgcctgattggcgggtcctcggggccgccctccccagcgcaccacccctgggttccctcccgggtccgcagtggaaacactgccctctcccttcttgacccctagcccttccttccctccctccttccctcctgtcgccgtctcttctggcgccgctgctcccggaggagctcccggcacggcgatgggttctcgggcctccacgttactgcgggacgaagagctcgaggagatcaagaaggagaccggctccgggaagatttccagaggattccagaacttgccatcaacccactgggggaccggatcatcaatgccttctttccagagggagaggaccaggtaaacttccgtggattcatgcgaactttggctcatttccgccccattgaggataatgaaaagagcaaagatgtgaatggacccgaaccactcaacagccgaagcaacaaactgcactttgcttttcgactatatgatttggataaagatgaaaagatctcccgtgatgagctgttacaggtgctacgcatgatggtcggagtaaatatctcagatgagcagctgggcagcatcgcagacaggaccattcaggaggctgatcaggatggggacagtgccatatctttcacagaatttgttaaggttttggagaaggtggatgtagaacagaaaatgagcatccgatttcttcactaaaggagaccaaactgttccttgcggtctagtatttaagaactggaacttgaaagtcctccttctaccaactccacctccaccccctcattccccttctcccaaagtactactgctgttgcatgacaaccccaaatatgttctgtcaacacaaacctgcctttggtgtataaacagggcattacagaatggtacaccctatatatttctgttcagtatccattcactagttcttcatttataaatatcatcttccccattctgctgctgaatgccacacatccatccagtctgagaaagtgagagaggcaatcatgccaagaacaagccagcaaagctctttcaccagatgtagactgtagccctgctgccttccctccagcgagtctgccagcatgcttcttcatcctttttatatgttctttgcttcctacttccctgtcttccaacatactgttcacttactctggcagtctttctgcttttcattaagcctcaaaatctcctctgttctacttggcaccacaagctatgtcctatatatgtatttctgacttggcaggatagttcaggggtctggcagtttttatttaccttcattattaaatgggcctctgggatgttgcctcttcaggagctttttggtaatcaatacttctctcagaagtatgagaccatcctctgcactctgctctgtcatcaaaggctgctgggtggagataccctttttgaaaggtggccttggtgagaggtatggagccaagtcttctaggttgcttgcccacatcactctatctctggcctctgattctcaactttgtacctgtgtggctcctcttgttagtgcaatgttgactgttgaaaaagcagcagtatgcttacaggtttgcttagtttggggacaccgttaccaccagaatggctgctctgacaatatgcctagggactttctcatggcttttatttaataaggaggctgggcaccctataaagcctcatgcattcacacctttgcagcatggtttatgcctcagtgttatgtgcactggaatgttttccacttcacatttccaagtagaaatattagtgttacggaagtgcctaatatcccagtccaaattttttttttttttttttttttttttttgagacagagtcttgctctgtcacccaggctggagtgcagtggtgcgatcgctcactgcaacctcagcctcctggatttaagtgattctcctgcctcagcctcccaagtagctgggattacaggtgtgcaccaccatgcccggctaattttttgtatttttagtggagacagggtttcaccatgttggccaggctggtctcgaactcctgacctcgtgatccgcctgcctcagcctcccaaagtgctgggattacaggtgtgagccaccacgcctggccccagtccaaaatatttaaagattgtttccttagtgtcttgaagttttgcacaaaattcttttttttgagatggagtctcactctgtcacccaggctggagtgcagtggcgtgatcttggctcactgcaacctctgcctcctgggttcaagcaattctcccacctcagcctcccaagtagctgggattacagacgtgtgccaccatacctgggtaatttttgcatttttagtggagagggagtttcaccatgttggccaggttggtcttgaactcctgacctcaggtgatcctcctgcctcggcctcccaaagtgctgggattacaggcatgagccaccgtgctcagccgcaaaattctttatgaattttacacttggcaaatgttaatgacggaagccatagtctgctcctaatacatgtccaaagcattgactgttgtgtcattagctgcctggttacattagctccctggcttcttgtttagaccactgctaatcccttaaaaacaagaggtctggcactagtagcacaacctaaggtggcattacagatctttgagcgagccacagcaacttttctgccaagtcagcttagtttagacttcagtgaatcaggctattgctatcctaatgtatgtctctatgagtgtatttagccacacatctgcccttggttgactttctgactcattgcttgcttgcttgtttccttgctttggaaaactattgaagattgctaaaaaataccactgcaaagtgatggaaaagggtggagaacaggggagtagccaggctggatggctcaaatataaatgaatgaggaattctttatgaagtatcagtcagattttatgattaagtgatgtaatataggaattatgtaaaagggaagaatgtctgatactgatctattagagaggtactttagaggcttcttgattggcataaagttcctaaggttatagattttccccccttttggctgtatagcaaagtgttttaatccacggttgtgccttattgttccattaaaattgtatcttcgatccatcaataaatacttgtggttgaaacaaaa

SEQ ID NO: 307344 - DNA, 2846 bp, Homo sapiens
gaattccgggcaaagctctttcaccagatgtagactgtagccctgctgccttccctccagcgagtctgccagcatgcttcttcatcctttttatatgttctttgcttccttccctccctccttccctcctgtcgccgtctcttctggcgccgctgctcccggaggagctcccggcacggcgatgggttctcgggcctccacgttactgcgggacgaagagctcgaggagatcaagaaggagaccggcttttcccacagtcaaatcactcgcctctacagccggttcaccagcctggacaaaggagagaatgggactctcagccgggaagatttccagaggattccagaacttgccatcaacccactgggggaccggatcatcaatgccttctttccagagggagaggaccaggtaaacttccgtggattcatgcgaactttggctcatttccgccccattgaggataatgaaaagagcaaagatgtgaatggacccgaaccactcaacagccgaagcaacaaactgcactttgcttttcgactatatgatttggataaagatgaaaagatctcccgtgatgagctgttacaggtgctacgcatgatggtcggagtaaatatctcagatgagcagctgggcagcatcgcagacaggaccattcaggaggctgatcaggatggggacagtgccatatctttcacagaatttgttaaggttttggagaaggtggatgtagaacagaaaatgagcatccgatttcttcactaaaggagaccaaactgttccttgcggtctagtatttaagaactggaacttgaaagtcctccttctaccaactccacctccaccccctcattccccttctcccaaagtactactgctgttgcatgacaaccccaaatatgttctgtcaacacaaacctgcctttggtgtataaacagggcattacagaatggtacaccctatatatttctgttcagtatccattcactagttcttcatttataaatatcatcttccccattctgctgctgaatgccacacatccatccagtctgagaaagtgagagaggcaatcatgccaagaacaagccagcaaagctctttcaccagatgtagactgtagccctgctgccttccctccagcgagtctgccagcatgcttcttcatcctttttatatgttctttgcttcctacttccctgtcttccaacatactgttcacttactctggcagtctttctgcttttcattaagcctcaaaatctcctctgttctacttggcaccacaagctatgtcctatatatgtatttctgacttggcaggatagttcaggggtctggcagtttttatttaccttcattattaaatgggcctctgggatgttgcctcttcaggagctttttggtaatcaatacttctctcagaagtatgagaccatcctctgcactctgctctgtcatcaaaggctgctgggtggagataccctttttgaaaggtggccttggtgagaggtatggagccaagtcttctaggttgcttgcccacatcactctatctctggcctctgattctcaactttgtacctgtgtggctcctcttgttagtgcaatgttgactgttgaaaaagcagcagtatgcttacaggtttgcttagtttggggacaccgttaccaccagaatggctgctctgacaatatgcctagggactttctcatggcttttatttaataaggaggctgggcaccctataaagcctcatgcattcacacctttgcagcatggtttatgcctcagcctcccaagtagctgggattacaggtgtgcaccaccatgcccggctaattttttgtatttttagtggagacagggtttcaccatgttggccaggctggtctctgcctcctgggttcaagcaattctcccacctcagcctcccaagtagctgggattacagacgtgtgccaccatacctgggtaatttttgcatttttagtggagagggagtttcaccatgttggccaggttggtcttgaactcctgacctcaggtgatcctcctgcctcggcctcccaaagtgctgggattacaggcatgagccaccgtgctcagccgcaaaattctttatgaattttacacttggcaaatgttaatgacggaagccatagtctgctcctaatacatgtccaaagcattgactgttgtgtcattagctgcctggttacattagctccctggcttcttgtttagaccactgctaatcccttaaaaacaagaggtctggcactagtagcacaacctaaggtggcattacagatctttgagcgagccacagcaacttttctgccaagtcagcttagtttagacttcagtgaatcaggctattgctatcctaatgtatgtctctatgagtgtatttagccacacatctgcccttggttgactttctgactcattgcttgcttgcttgtttccttgctttggaaaactattgaagattgctaaaaaataccactgcaaagtgatggaaaagggtggagaacaggggagtagccaggctggatggctcaaatataaatgaatgaggaattctttatgaagtatcagtcagattttatgattaagtgatgtaatataggaattatgtaaaagggaagaatgtctgatactgatctattagagaggtactttagaggcttcttgattggcataaagttcctaaggttatagattttccccccttttggctgtatagcaaagtgttttaatccacggttgtgccttattgttccattaaaattgtatcttcgatccatcaataaatacttgtggttgaaacaaaa

SEQ ID NO: 307345 - DNA, 4109 bp, Homo sapiens
ggcagagggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcaaaaaaaaaaaaaaaaaactcgagactagttctctctctctcctcgaacgctgacgttggctcctgagccgggcgctgcctcgcgcctgattggcgggtcctcggggccgccctccccagcgcaccacccctgggttccctcccgggtccgcagtggaaacactgccctctcccttcttgacccctagcccttccttccctccctccttccctcctgtcgccgtctcttctggcgccgctgctcccggaggagctcccggcacggcgatgggttctcgggcctccacgttactgcgggacgaagagctcgaggagatcaagaaggagaccggcttttcccacagtcaaatcactcgcctctacagccggttcaccagcctggacaaaggagagaatgggactctcagccgggaagatttccagaggattccagaacttgccatcaacccactgggggaccggatcatcaatgccttctttccagagggcagagtgatcctaggtgtataacattccgttgtgattcgatgctggaactttgcgctcaatttcctgcctccatgggaggtataactgaaagaagagcataggagagtgtgcatagtggagcccgaagccagccgtctagagcatgcctgaatgcaacagaacgtgcaacttgtgcttttgccgactatatgagtttggactatacacgatgatagaagatcttcccgtgtatgatgcatgttacgaggtgctacgcatgatggtcggagtaaatatctcagatgagcagctgggcagcatcgcagacaggaccattcaggaggctgatcaggatggggacagtgccatatctttcacagaatttgttaaggttttggagaaggtggatgtagaacagaaaatgagcatccgatttcttcactaaaggagaccaaactgttccttgcggtctagtatttaagaactggaacttgaaagtcctccttctaccaactccacctccaccccctcattccccttctcccaaagtactactgctgttgcatgacaaccccaaatatgttctgtcaacacaaacctgcctttggtgtataaacagggcattacagaatggtacaccctatatatttctgttcagtatccattcactagttcttcatttataaatatcatcttccccattctgctgctgaatgccacacatccatccagtctgagaaagtgagagaggcaatcatgccaagaacaagccagcaaagctctttcaccagatgtagactgtagccctgctgccttccctccagcgagtctgccagcatgcttcttcatcctttttatatgttctttgcttcctacttccctgtcttccaacatactgttcacttactctggcagtctttctgcttttcattaagcctcaaaatctcctctgttctacttggcaccacaagctatgtcctatatatgtatttctgacttggcaggatagttcaggggtctggcagtttttatttaccttcattattaaatgggcctctgggatgttgcctcttcaggagctttttggtaatcaatacttctctcagaagtatgagaccatcctctgcactctgctctgtcatcaaaggctgctgggtggagataccctttttgaaaggtggccttggtgagaggtatggagccaagtcttctaggttgcttgcccacatcactctatctctggcctctgattctcaactttgtacctgtgtggctcctcttgttagtgcaatgttgactgttgaaaaagcagcagtatgcttacaggtttgcttagtttggggacaccgttaccaccagaatggctgctctgacaatatgcctagggactttctcatggcttttatttaataaggaggctgggcaccctataaagcctcatgcattcacacctttgcagcatggtttatgcctcagtgttatgtgcactggaatgttttccacttcacatttccaagtagaaatattagtgttacggaagtgcctaatatcccagtccaaattttttttttttttttttttttttttttgagacagagtcttgctctgtcacccaggctggagtgcagtggtgcgatcgctcactgcaacctcagcctcctggatttaagtgattctcctgcctcagcctcccaagtagctgggattacaggtgtgcaccaccatgcccggctaattttttgtatttttagtggagacagggtttcaccatgttggccaggctggtctcgaactcctgacctcgtgatccgcctgcctcagcctcccaaagtgctgggattacaggtgtgagccaccacgcctggccccagtccaaaatatttaaagattgtttccttagtgtcttgaagttttgcacaaaattcttttttttgagatggagtctcactctgtcacccaggctggagtgcagtggcgtgatcttggctcactgcaacctctgcctcctgggttcaagcaattctcccacctcagcctcccaagtagctgggattacagacgtgtgccaccatacctgggtaatttttgcatttttagtggagagggagtttcaccatgttggccaggttggtcttgaactcctgacctcaggtgatcctcctgcctcggcctcccaaagtgctgggattacaggcatgagccaccgtgctcagccgcaaaattctttatgaattttacacttggcaaatgttaatgacggaagccatagtctgctcctaatacatgtccaaagcattgactgttgtgtcattagctgcctggttacattagctccctggcttcttgtttagaccactgctaatcccttaaaaacaagaggtctggcactagtagcacaacctaaggtggcattacagatctttgagcgagccacagcaacttttctgccaagtcagcttagtttagacttcagtgaatcaggctattgctatcctaatgtatgtctctatgagtgtatttagccacacatctgcccttggttgactttctgactcattgcttgcttgcttgtttccttgctttggaaaactattgaagattgctaaaaaataccactgcaaagtgatggaaaagggtggagaacaggggagtagccaggctggatggctcaaatataaatgaatgaggaattctttatgaagtatcagtcagattttatgattaagtgatgtaatataggaattatgtaaaagggaagaatgtctgatactgatctattagagaggtactttagaggcttcttgattggcataaagttcctaaggttatagattttccccccttttggctgtatagcaaagtgttttaatccacggttgtgccttattgttccattaaaattgtatcttcgatccatcaataaatacttgtggttgaaacaaaa

SEQ ID NO: 307346 - DNA, 2884 bp, Homo sapiens
aaatggagaccatcctggctaaacagtggaaccccgtctgtagtaaaaataccaaaaaattagccggccggagtggcaagcacctgtagtcccagctacttgggaggctgaggcagaagaatggcttgaacccaggaggccaaggttgcagtgagccgagaccacaccactgcactccagcctggcaaaagagtgagactctgcctccaaaaaaaaaaaaaagttacgttttactgcacaggaggaaggggggaaaacattactcagataagagcttgggagtgttgtaatcttcataacctttgtaactgttactggttttctcccccaggttttggagaaggtggatgtagaacagaaaatgagcatccgatttcttcactaaaggagaccaaactgttccttgcggtctagtatttaagaactggaacttgaaagtcctccttctaccaactccacctccaccccctcattccccttctcccaaagtactactgctgttgcatgacaaccccaaatatgttctgtcaacacaaacctgcctttggtgtataaacagggcattacagaatggtacaccctatatatttctgttcagtatccattcactagttcttcatttataaatatcatcttccccattctgctgctgaatgccacacatccatccagtctgagaaagtgagagaggcaatcatgccaagaacaagccagcaaagctctttcaccagatgtagactgtagccctgctgccttccctccagcgagtctgccagcatgcttcttcatcctttttatatgttctttgcttcctacttccctgtcttccaacatactgttcacttactctggcagtctttctgcttttcattaagcctcaaaatctcctctgttctacttggcaccacaagctatgtcctatatatgtatttctgacttggcaggatagttcaggggtctggcagtttttatttaccttcattattaaatgggcctctgggatgttgcctcttcaggagctttttggtaatcaatacttctctcagaagtatgagaccatcctctgcactctgctctgtcatcaaaggctgctgggtggagataccctttttgaaaggtggccttggtgagaggtatggagccaagtcttctaggttgcttgcccacatcactctatctctggcctctgattctcaactttgtacctgtgtggctcctcttgttagtgcaatgttgactgttgaaaaagcagcagtatgcttacaggtttgcttagtttggggacaccgttaccaccagaatggctgctctgacaatatgcctagggactttctcatggcttttatttaataaggaggctgggcaccctataaagcctcatgcattcacacctttgcagcatggtttatgcctcagtgttatgtgcactggaatgttttccacttcacatttccaagtagaaatattagtgttacggaagtgcctaatatcccagtccaaattttttttttttttttttttttttttttgagacagagtcttgctctgtcacccaggctggagtgcagtggtgcgatcgctcactgcaacctcagcctcctggatttaagtgattctcctgcctcagcctcccaagtagctgggattacaggtgtgcaccaccatgcccggctaattttttgtatttttagtggagacagggtttcaccatgttggccaggctggtctcgaactcctgacctcgtgatccgcctgcctcagcctcccaaagtgctgggattacaggtgtgagccaccacgcctggccccagtccaaaatatttaaagattgtttccttagtgtcttgaagttttgcacaaaattcttttttttgagatggagtctcactctgtcacccaggctggagtgcagtggcgtgatcttggctcactgcaacctctgcctcctgggttcaagcaattctcccacctcagcctcccaagtagctgggattacagacgtgtgccaccatacctgggtaatttttgcatttttagtggagagggagtttcaccatgttggccaggttggtcttgaactcctgacctcaggtgatcctcctgcctcggcctcccaaagtgctgggattacaggcatgagccaccgtgctcagccgcaaaattctttatgaattttacacttggcaaatgttaatgacggaagccatagtctgctcctaatacatgtccaaagcattgactgttgtgtcattagctgcctggttacattagctccctggcttcttgtttagaccactgctaatcccttaaaaacaagaggtctggcactagtagcacaacctaaggtggcattacagatctttgagcgagccacagcaacttttctgccaagtcagcttagtttagacttcagtgaatcaggctattgctatcctaatgtatgtctctatgagtgtatttagccacacatctgcccttggttgactttctgactcattgcttgcttgcttgtttccttgctttggaaaactattgaagattgctaaaaaataccactgcaaagtgatggaaaagggtggagaacaggggagtagccaggctggatggctcaaatataaatgaatgaggaattctttatgaagtatcagtcagattttatgattaagtgatgtaatataggaattatgtaaaagggaagaatgtctgatactgatctattagagaggtactttagaggcttcttgattggcataaagttcctaaggttatagattttccccccttttggctgtatagcaaagtgttttaatccacggttgtgccttattgttccattaaaattgtatcttcgatccatcaataaatacttgtggttgaaacaaaa

SEQ ID NO: 307347 - DNA, 3479 bp, Homo sapiens
gaattccgggcaaagctctttcaccagatgtagactgtagccctgctgccttccctccagcgagtctgccagcatgcttcttcatcctttttatatgttctttgcttccttccctccctccttccctcctgtcgccgtctcttctggcgccgctgctcccggaggagctcccggcacggcgatgggttctcgggcctccacgttactgcgggacgaagagctcgaggagatcaagaaggagaccggcttttcccacagtcaaatcactcgcctctacagccggttcaccagcctggacaaaggagagaatgggactctcagccgggaagatttccagaggattccagaacttgccatcaacccactgggggaccggatcatcaatgccttctttccagagggagaggaccaggtaaacttccgtggattcatgcgaactttggctcatttccgccccattgaggataatgaaaagagcaaagatgtgaatggacccgaaccactcaacagccgaagcaacaaactgcactttgcttttcgactatatgatttggataaagatgaaaagatctcccgtgatgagctgttacaggtgctacgcatgatggtcggagtaaatatctcagatgagcagctgggcagcatcgcagacaggaccattcaggaggctgatcaggatggggacagtgccatatctttcacagaatttgttaaggttttggagaaggtggatgtagaacagaaaatgagcatccgatttcttcactaaaggagaccaaactgttccttgcggtctagtatttaagaactggaacttgaaagtcctccttctaccaactccacctccaccccctcattccccttctcccaaagtactactgctgttgcatgacaaccccaaatatgttctgtcaacacaaacctgcctttggtgtataaacagggcattacagaatggtacaccctatatatttctgttcagtatccattcactagttcttcatttataaatatcatcttccccattctgctgctgaatgccacacatccatccagtctgagaaagtgagagaggcaatcatgccaagaacaagccagcaaagctctttcaccagatgtagactgtagccctgctgccttccctccagcgagtctgccagcatgcttcttcatcctttttatatgttctttgcttcctacttccctgtcttccaacatactgttcacttactctggcagtctttctgcttttcattaagcctcaaaatctcctctgttctacttggcaccacaagctatgtcctatatatgtatttctgacttggcaggatagttcaggggtctggcagtttttatttaccttcattattaaatgggcctctgggatgttgcctcttcaggagctttttggtaatcaatacttctctcagaagtatgagaccatcctctgcactctgctctgtcatcaaaggctgctgggtggagataccctttttgaaaggtggccttggtgagaggtatggagccaagtcttctaggttgcttgcccacatcactctatctctggcctctgattctcaactttgtacctgtgtggctcctcttgttagtgcaatgttgactgttgaaaaagcagcagtatgcttacaggtttgcttagtttggggacaccgttaccaccagaatggctgctctgacaatatgcctagggactttctcatggcttttatttaataaggaggctgggcaccctataaagcctcatgcattcacacctttgcagcatggtttatgcctcagtgttatgtgcactggaatgttttccacttcacatttccaagtagaaatattagtgttacggaagtgcctaatatcccagtccaaattttttttttttttttttttttttttttgagacagagtcttgctctgtcacccaggctggagtgcagtggtgcgatcgctcactgcaacctcagcctcctggatttaagtgattctcctgcctcagcctcccaagtagctgggattacaggtgtgcaccaccatgcccggctaattttttgtatttttagtggagacagggtttcaccatgttggccaggctggtctcgaactcctgacctcgtgatccgcctgcctcagcctcccaaagtgctgggattacaggtgtgagccaccacgcctggccccagtccaaaatatttaaagattgtttccttagtgtcttgaagttttgcacaaaattcttttttttgagatggagtctcactctgtcacccaggctggagtgcagtggcgtgatcttggctcactgcaacctctgcctcctgggttcaagcaattctcccacctcagcctcccaagtagctgggattacagacgtgtgccaccatacctgggtaatttttgcatttttagtggagagggagtttcaccatgttggccaggttggtcttgaactcctgacctcaggtgatcctcctgcctcggcctcccaaagtgctgggattacaggcatgagccaccgtgctcagccgcaaaattctttatgaattttacacttggcaaatgttaatgacggaagccatagtctgctcctaatacatgtccaaagcattgactgttgtgtcattagctgcctggttacattagctccctggcttcttgtttagaccactgctaatcccttaaaaacaagaggtctggcactagtagcacaacctaaggtggcattacagatctttgagcgagccacagcaacttttctgccaagtcagcttagtttagacttcagtgaatcaggctattgctatcctaatgtatgtctctatgagtgtatttagccacacatctgcccttggttgactttctgactcattgcttgcttgcttgtttccttgctttggaaaactattgaagattgctaaaaaataccactgcaaagtgatggaaaagggtggagaacaggggagtagccaggctggatggctcaaatataaatgaatgaggaattctttatgaagtatcagtcagattttatgattaagtgatgtaatataggaattatgtaaaagggaagaatgtctgatactgatctattagagaggtactttagaggcttcttgattggcataaagttcctaaggttatagattttccccccttttggctgtatagcaaagtgttttaatccacggttgtgccttattgttccattaaaattgtatcttcgatccatcaataaatacttgtggttgaaacaaaaaaaaaaaaacaaacaaaaacaagagggggggtaaaaaaatcccagggggacaagtaaaggacgaaccgagtttgtgaaaagggcgccaaaaggagggattaaaagacgagggcgctttaaagtgagggaacgttggggtttgaaagaacttcttggtggcattggacacccgataagcgggaaaatagttggaacgctgggagttgttaag

SEQ ID NO: 307348 - DNA, 3576 bp, Homo sapiens
  misc_feature (3270)..(3270): n is a, c, g, or t
gaattccgggcaaagctctttcaccagatgtagactgtagccctgctgccttccctccagcgagtctgccagcatgcttcttcatcctttttatatgttctttgcttccttccctccctccttccctcctgtcgccgtctcttctggcgccgctgctcccggaggagctcccggcacggcgatgggttctcgggcctccacgttactgcgggacgaagagctcgaggagatcaagaaggagaccggcttttcccacagtcaaatcactcgcctctacagccggttcaccagcctggacaaaggagagaatgggactctcagccgggaagatttccagaggattccagaacttgccatcaacccactgggggaccggatcatcaatgccttctttccagagggagaggaccaggtaaacttccgtggattcatgcgaactttggctcatttccgccccattgaggataatgaaaagagcaaagatgtgaatggacccgaaccactcaacagccgaagcaacaaactgcactttgcttttcgactatatgatttggataaagatgaaaagatctcccgtgatgagctgttacaggtgctacgcatgatggtcggagtaaatatctcagatgagcagctgggcagcatcgcagacaggaccattcaggaggctgatcaggatggggacagtgccatatctttcacagaatttgttaaggttttggagaaggtggatgtagaacagaaaatgagcatccgatttcttcactaaaggagaccaaactgttccttgcggtctagtatttaagaactggaacttgaaagtcctccttctaccaactccacctccaccccctcattccccttctcccaaagtactactgctgttgcatgacaaccccaaatatgttctgtcaacacaaacctgcctttggtgtataaacagggcattacagaatggtacaccctatatatttctgttcagtatccattcactagttcttcatttataaatatcatcttccccattctgctgctgaatgccacacatccatccagtctgagaaagtgagagaggcaatcatgccaagaacaagccagcaaagctctttcaccagatgtagactgtagccctgctgccttccctccagcgagtctgccagcatgcttcttcatcctttttatatgttctttgcttcctacttccctgtcttccaacatactgttcacttactctggcagtctttctgcttttcattaagcctcaaaatctcctctgttctacttggcaccacaagctatgtcctatatatgtatttctgacttggcaggatagttcaggggtctggcagtttttatttaccttcattattaaatgggcctctgggatgttgcctcttcaggagctttttggtaatcaatacttctctcagaagtatgagaccatcctctgcactctgctctgtcatcaaaggctgctgggtggagataccctttttgaaaggtggccttggtgagaggtatggagccaagtcttctaggttgcttgcccacatcactctatctctggcctctgattctcaactttgtacctgtgtggctcctcttgttagtgcaatgttgactgttgaaaaagcagcagtatgcttacaggtttgcttagtttggggacaccgttaccaccagaatggctgctctgacaatatgcctagggactttctcatggcttttatttaataaggaggctgggcaccctataaagcctcatgcattcacacctttgcagcatggtttatgcctcagtgttatgtgcactggaatgttttccacttcacatttccaagtagaaatattagtgttacggaagtgcctaatatcccagtccaaattttttttttttttttttttttttttttgagacagagtcttgctctgtcacccaggctggagtgcagtggtgcgatcgctcactgcaacctcagcctcctggatttaagtgattctcctgcctcagcctcccaagtagctgggattacaggtgtgcaccaccatgcccggctaattttttgtatttttagtggagacagggtttcaccatgttggccaggctggtctcgaactcctgacctcgtgatccgcctgcctcagcctcccaaagtgctgggattacaggtgtgagccaccacgcctggccccagtccaaaatatttaaagattgtttccttagtgtcttgaagttttgcacaaaattcttttttttgagatggagtctcactctgtcacccaggctggagtgcagtggcgtgatcttggctcactgcaacctctgcctcctgggttcaagcaattctcccacctcagcctcccaagtagctgggattacagacgtgtgccaccatacctgggtaatttttgcatttttagtggagagggagtttcaccatgttggccaggttggtcttgaactcctgacctcaggtgatcctcctgcctcggcctcccaaagtgctgggattacaggcatgagccaccgtgctcagccgcaaaattctttatgaattttacacttggcaaatgttaatgacggaagccatagtctgctcctaatacatgtccaaagcattgactgttgtgtcattagctgcctggttacattagctccctggcttcttgtttagaccactgctaatcccttaaaaacaagaggtctggcactagtagcacaacctaaggtggcattacagatctttgagcgagccacagcaacttttctgccaagtcagcttagtttagacttcagtgaatcaggctattgctatcctaatgtatgtctctatgagtgtatttagccacacatctgcccttggttgactttctgactcattgcttgcttgcttgtttccttgctttggaaaactattgaagattgctaaaaaataccactgcaaagtgatggaaaagggtggagaacaggggagtagccaggctggatggctcaaatataaatgaatgaggaattctttatgaagtatcagtcagattttatgattaagtgatgtaatataggaattatgtaaaagggaagaatgtctgatactgatctattagagaggtactttagaggcttcttgattggcataaagttcctaaggttatagattttccccccttttggctgtatagcaaagtgttttaatccacggttgtgccttattgttccattaaaattgtatcttcgatccatcaataaatacttgtggttgaaacaaaaanaaaaaaaaaaaaaaaaaaaaaaaaaaaaaaaaaaaaaaaaaaaaaaaaaaaagggggggggggcgccccaatcccctccggagggggagcaacaatatatcataccagatacaaccgagtgtgtggtagaaaacaagggggcgccccacaaggaggggaggctcaataaacaacagacagagagacagaggcacgtattataacaacgacgttgggtgggcggagaaaacagtcgctacggcgcgaaactccttcgggaagagaaaccccacatcaggcggggggaacaaacgcggagaacatatg

SEQ ID NO: 307349 - DNA, 3244 bp, Homo sapiens
gaattccgggcaaagctctttcaccagatgtagactgtagccctgctgccttccctccagcgagtctgccagcatgcttcttcatcctttttatatgttctttgcttccttccctccctccttccctcctgtcgccgtctcttctggcgccgctgctcccggaggagctcccggcacggcgatgggttctcgggcctccacgttactgcgggacgaagagctcgaggagatcaagaaggagaccggcttttcccacagtcaaatcactcgcctctacagccggttcaccagcctggacaaaggagagaatgggactctcagccgggaagatttccagaggattccagaacttgccatcaacccactgggggaccggatcatcaatgccttctttccagagggagaggaccaggtaaacttccgtggattcatgcgaactttggctcatttccgccccattgaggataatgaaaagagcaaagatgtgaatggacccgaaccactcaacagccgaagcaacaaactgcactttgcttttcgactatatgatttggataaagatgaaaagatctcccgtgatgagctgttacaggtgctacgcatgatggtcggagtaaatatctcagatgagcagctgggcagcatcgcagacaggaccattcaggaggctgatcaggatggggacagtgccatatctttcacagaatttgttaaggttttggagaaggtggatgtagaacagaaaatgagcatccgatttcttcactaaaggagaccaaactgttccttgcggtctagtatttaagaactggaacttgaaagtcctccttctaccaactccacctccaccccctcattccccttctcccaaagtactactgctgttgcatgacaaccccaaatatgttctgtcaacacaaacctgcctttggtgtataaacagggcattacagaatggtacaccctatatatttctgttcagtatccattcactagttcttcatttataaatatcatcttccccattctgctgctgaatgccacacatccatccagtctgagaaagtgagagaggcaatcatgccaagaacaagccagcaaagctctttcaccagatgtagactgtagccctgctgccttccctccagcgagtctgccagcatgcttcttcatcctttttatatgttctttgcttcctacttccctgtcttccaacatactgttcacttactctggcagtctttctgcttttcattaagcctcaaaatctcctctgttctacttggcaccacaagctatgtcctatatatgtatttctgacttggcaggatagttcaggggtctggcagtttttatttaccttcattattaaatgggcctctgggatgttgcctcttcaggagctttttggtaatcaatacttctctcagaagtatgagaccatcctctgcactctgctctgtcatcaaaggctgctgggtggagataccctttttgaaaggtggccttggtgagaggtatggagccaagtcttctaggttgcttgcccacatcactctatctctggcctctgattctcaactttgtacctgtgtggctcctcttgttagtgcaatgttgactgttgaaaaagcagcagtatgcttacaggtttgcttagtttggggacaccgttaccaccagaatggctgctctgacaatatgcctagggactttctcatggcttttatttaataaggaggctgggcaccctataaagcctcatgcattcacacctttgcagcatggtttatgcctcagtgttatgtgcactggaatgttttccacttcacatttccaagtagaaatattagtgttacggaagtgcctaatatcccagtccaaattttttttttttttttttttttttttttgagacagagtcttgctctgtcacccaggctggagtgcagtggtgcgatcgctcactgcaacctcagcctcctggatttaagtgattctcctgcctcagcctcccaagtagctgggattacaggtgtgcaccaccatgcccggctaattttttgtatttttagtggagacagggtttcaccatgttggccaggctggtctcgaactcctgacctcgtgatccgcctgcctcagcctcccaaagtgctgggattacaggtgtgagccaccacgcctggccccagtccaaaatatttaaagattgtttccttagtgtcttgaagttttgcacaaaattcttttttttgagatggagtctcactctgtcacccaggctggagtgcagtggcgtgatcttggctcactgcaacctctgcctcctgggttcaagcaattctcccacctcagcctcccaagtagctgggattacagacgtgtgccaccatacctgggtaatttttgcatttttagtggagagggagtttcaccatgttggccaggttggtcttgaactcctgacctcaggtgatcctcctgcctcggcctcccaaagtgctgggattacaggcatgagccaccgtgctcagccgcaaaattctttatgaattttacacttggcaaatgttaatgacggaagccatagtctgctcctaatacatgtccaaagcattgactgttgtgtcattagctgcctggttacattagctccctggcttcttgtttagaccactgctaatcccttaaaaacaagaggtctggcactagtagcacaacctaaggtggcattacagatctttgagcgagccacagcaacttttctgccaagtcagcttagtttagacttcagtgaatcaggctattgctatcctaatgtatgtctctatgagtgtatttagccacacatctgcccttggttgactttctgactcattgcttgcttgcttgtttccttgctttggaaaactattgaagattgctaaaaaataccactgcaaagtgatggaaaagggtggagaacaggggagtagccaggctggatggctcaaatataaatgaatgaggaattctttatgaagtatcagtcagattttatgatttaaaagggaagaatgtctgatactgatctattagagaggtactttagaggcttcttgattggcataaagttcctaaggttatagattttccccccttttggctgtatagcaaagtgttttaatccacggttgtgccttattgttccattaaaattgtatcttcgatccatcaataaatacttgtggttgaaacaaaa

SEQ ID NO: 307350 - DNA, 1481 bp, Homo sapiens
gaattccgggcaaagctctttcaccagatgtagactgtagccctgctgccttccctccagcgagtctgccagcatgcttcttcatcctttttatatgttctttgcttccttccctccctccttccctcctgtcgccgtctcttctggcgccgctgctcccggaggagctcccggcacggcgatgggttctcgggcctccacgttactgcgggacgaagagctcgaggagatcaagaaggagaccggcttttcccacagtcaaatcactcgcctctacagccggttcaccagcctggacaaaggagagaatgggactctcagccgggaagatttccagaggattccagaacttgccatcaacccactgggggaccggatcatcaatgccttctttccagagggagaggaccaggtaaacttccgtggattcatgcgaactttggctcatttccgccccattgaggataatgaaaagagcaaagatgtgaatggacccgaaccactcaacagccgaagcaacaaactgcactttgcttttcgactatatgatttggataaagatgaaaagatctcccgtgatgagctgttacaggtgctacgcatgatggtcggagtaaatatctcagatgagcagctgggcagcatcgcagacaggaccattcaggaggctgatcaggatggggacagtgccatatctttcacagaatttgttaaggttttggagaaggtggatgtagaacagaaaatgagcatccgatttcttcactaaaggagaccaaactgttccttgcggtctagtatttaagaactggaacttgaaagtcctccttctaccaactccacctccaccccctcattccccttctcccaaagtactactgctgttgcatgacaaccccaaatatgttctgtcaacacaaacctgcctttggtgtataaacagggcattacagaatggtacaccctatatatttctgttcagtatccattcactagttcttcatttataaatatcatcttccccattctgctgctgaatgccacacatccatccagtctgagaaagtgagagaggcaatcatgccaagaacaagccagcaaagctctttcaccagatgtagactgtagccctgctgccttccctccagcgagtcttccaacatactgttcacttactctggcagtctttctgcttttcattaagctcaaatataaatgaatgaggaattctttatgaagtatcagtcagattttatgattaagtgatgtaatataggaattatgtaaaagggaagaatgtctgatactgatctattagagaggtactttagaggcttcttgattggcataaagttcctaaggttatagattttccccccttttggctgtatagcaaagtgttttaatccacggttgtgccttattgttccattaaaattgtatcttcgatccatcaataaatacttgtggttgaaacaaaa

SEQ ID NO: 307351 - DNA, 1644 bp, Homo sapiens
ggcagagggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcaaaaaaaaaaaaaaaaaactcgagactagttctctctctctcctcgaacgctgacgttggctcctgagccgggcgctgcctcgcgcctgattggcgggtcctcggggccgccctccccagcgcaccacccctgggttccctcccgggtccgcagtggaaacactgccctctcccttcttgacccctagcccttccttccctccctccttccctcctgtcgccgtctcttctggcgccgctgctcccggaggagctcccggcacggcgatgggttctcgggcctccacgttactgcgggacgaagagctcgaggagatcaagaaggagaccggcttttcccacagtcaaatcactcgcctctacagccggttcaccagcctggacaaaggagagaatgggactctcagccgggaagatttccagaggattccagaacttgccatcaacccactgggggaccggatcatcaatgccttctttccagagggagaggaccaggtaaacttccgtggattcatgcgaactttggctcatttccgccccattgaggataatgaaaagagcaaagatgtgaatggacccgaaccactcaacagccgaagcaacaaactgcactttgcttttcgactatatgatttggataaagatgaaaagatctcccgtgatgagctgttacagtagagacggggtttcagcatattggccaggctggtctcgaactcctaacctcaagtgatccacccacctcggcctcccaaagtgctgggagtacaagcacgagccatcatgcctggccccaactgtccattttaaatatgtacagcttattgtatattatttatacttcaataaagatagttactcgggaggctgaggcaggagaatggtgtgaacctaggaggcggagcttgcagtgagccgagatcacgctactgcactccagcctg

SEQ ID NO: 307352 - DNA, 1431 bp, Homo sapiens
ggcagagggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcaaaaaaaaaaaaaaaaaactcgagactagttctctctctctcctcgaacgctgacgttggctcctgagccgggcgctgcctcgcgcctgattggcgggtcctcggggccgccctccccagcgcaccacccctgggttccctcccgggtccgcagtggaaacactgccctctcccttcttgacccctagcccttccttccctccctccttccctcctgtcgccgtctcttctggcgccgctgctcccggaggagctcccggcacggcgatgggttctcgggcctccacgttactgcgggacgaagagctcgaggagatcaagaaggagaccggcttttcccacagtcaaatcactcgcctctacagccggttcaccagcctggacaaaggagagaatgggactctcagccgggaagatttccagaggattccagaacttgccatcaacccactgggggaccggatcatcaatgccttctttccagagggagaggaccaggtcaaaatgcagatcttcgtgaaaacccttaccggcaagaccatcacccttgaggtggagcccagtgacaccatcgaaaatgtgaaggccaagatccaggataaggaaggcattccccccggacagcagaggctcatctttgcaggcaagcagctggaagatggccgtactctttctgactacaacatccagaaggagtcgaccctgcacctggtcctgcgtctgagaggtggatg

SEQ ID NO: 307353 - DNA, 2383 bp, Homo sapiens
agtcggaagtggcaccagcacttccggtacggaaaactcgctgctgccccaacctggcttgacaggcttggtctctgcaagtggctctcagccccttcttctttcctgcctcaccttccaattcgtttgccgccgccgtcccgcagctgctgtttccggagttgccccttccccatgttccggggcaggagtccgcaaagcgaagatccgcccgccggttcctcatcatgtccgaactgactaaagagctgatggagctggtgtggggcaccaagagcagccccggtctctcggacaccattttctgccgctggacgcaagggtttgtgtttagtgaatcagagggatctgcattagaacagtttgaaggtggcccctgtgctgttattgcacctgttcaggcatttcttttgaagaagctcctgttttcttcggagaagtcttcttggcgggattgttcagaggaagagcagaaggaactcctttgtcataccttgtgtgatattttagaaagtgcttgttgtgaccactctggatcatactgcttggtttcatggttaagaggaaagacaactgaggaaactgctagtatttctgggagtcctgcagagtctagttgccaagtggaacattcttctgccttggctgtcgaagagcttggctttgagcgatttcatgcattaattcaaaaaagatcgttcagaagtttaccagaattaaaagatgctgtcttggaccagtattcaatgtggggaaataaatttggagtattgctttttctgtattctgtattactgacaaagggcattgaaaacataaaaaacgaaattgaagatgcaagtgaacccttgatagatcctgtatatggacatggcagccaaagtttaattaatctcctgctgacgggacatgctgtttctaatgtatgggatggtgatagagagtgctcaggaatgaaacttcttggtatacatgaacaagcagcagtaggatttttaacactaatggaagctttaagatactgtaaggttggttcttacttgaaatctccaaaattccctatttggattgttggcagtgagactcacctcaccgtattttttgccaaggatatggctttagttgcccctgaagctccttcagaacaagccagaagagtttttcaaacctacgacccagaagataatggattcatacccgattcacttctggaagatgtgatgaaagcattggaccttgtttcagatcctgaatatataaatctcatgaagaataaattagatccagaaggattaggaatcatattattgggcccatttcttcaagaattttttcctgatcagggctccagtggtccagaatcttttactgtctaccactacaatggattgaagcagtcaaattataatgaaaaggtcatgtacgtagaagggactgcagttgtgatgggttttgaagatcccatgctacagacagatgacactcctattaaacgctgtctgcaaaccaaatggccatacattgagttactctggaccacagatcgctctccttcactaaattaatttgtctaagtatttataaggaagatcttaataacagatgttgaaagaaggagtcaagactggcaattggctggattaagctaaacactggtatcactgattaactgtaaataacaattaaaaacacattttcagtgtttatgatatgtttaaattatttgtcctaaagctttatgttaaagattatcctattttaccccttcgtgtgaaatttactagcaaaattaagctttcatcaaagttcatcacttttgcattcagatacttggtcatttacttaccaaattacaaacgcaatactacagcatttgtatattaagtatcacagttactattgataaactacttttgggttttatttcattgaggcactttttttattgtttgaatgattccggcttgtaatatatcagcctctacaatgaaatgcagaagagttcatttttctaagatctgtttttcattagaaatattgacaaataacacattgtcaacctggatcctttgacaatttacttaactctggcatgttcacaaaaagtagaaactctaagagaccattaccatttattcacagatgtataggggatgtattctaaaaactgacagaaaagagaatctgatagtcaacactgttaacttttactgtgtaattgccaaatacacttttccaaatttgtcccaacagccctgtaagccagctttcttctatatttataaacacgataaatgcatgagaagatctgttattacattagtatattacgttatttattatgatcctagttgatggcctaaataaacacctttttctttaa

SEQ ID NO: 307354 - DNA, 472 bp, Homo sapiens
cccagtcaaaggataaggatttgagaaacatgcattttactttcagttgattagaaattgcctgatataaatataatttaaagtgttaatagtcctttatttataatagggctccagtggtccagaatcttttactgtctaccactacaatggattgaagcagtcaaattataatgaaaaggtcatgtacgtagaagggactgcagttgtgatgggttttgaagatcccatgctacagacagatgacactcctattaaacgctgtctgcaaaccaaatggccatacattgagttactctggaccacagatcgctctccttcactaaattaatttgtctaagtatttataaggaagatcttaataacagatgttgaaagaaggagtcaagactggcaattggctggattaagctaaacactggtatcactgattaactgtaaataacaattaaaaacacattttcagtgttta

SEQ ID NO: 307355 - DNA, 2331 bp, Homo sapiens
agtcggaagtggcaccagcacttccggtacggaaaactcgctgctgccccaacctggcttgacaggcttggtctctgcaagtggctctcagccccttcttctttcctgcctcaccttccaattcgtttgccgccgccgtcccgcagctgctgtttccggagttgccccttccccatgttccggggcaggagtccgcaaagcgaagatccgcccgccggttcctcatcatgtccgaactgactaaagagctgatggagctggtgtggggcaccaagagcagccccggtctctcggacaccattttctgccgctggacgcaagggtttgtgtttagtgaatcagagggatctgcattagaacagtttgaaggtggcccctgtgctgttattgcacctgttcaggcatttcttttgaagaagctcctgttttcttcggagaagtcttcttggcgggattgttcagaggaagagcagaaggaactcctttgtcataccttgtgtgatattttagaaagtgcttgttgtgaccactctggatcatactgcttggtttcatggttaagaggaaagacaactgaggaaactgctagtatttctgggagtcctgcagagtctagttgccaagtggaacattcttaaaaagatcgttcagaagtttaccagaattaaaagatgctgtcttggaccagtattcaatgtggggaaataaatttggagtattgctttttctgtattctgtattactgacaaagggcattgaaaacataaaaaacgaaattgaagatgcaagtgaacccttgatagatcctgtatatggacatggcagccaaagtttaattaatctcctgctgacgggacatgctgtttctaatgtatgggatggtgatagagagtgctcaggaatgaaacttcttggtatacatgaacaagcagcagtaggatttttaacactaatggaagctttaagatactgtaaggttggttcttacttgaaatctccaaaattccctatttggattgttggcagtgagactcacctcaccgtattttttgccaaggatatggctttagttgcccctgaagctccttcagaacaagccagaagagtttttcaaacctacgacccagaagataatggattcatacccgattcacttctggaagatgtgatgaaagcattggaccttgtttcagatcctgaatatataaatctcatgaagaataaattagatccagaaggattaggaatcatattattgggcccatttcttcaagaattttttcctgatcagggctccagtggtccagaatcttttactgtctaccactacaatggattgaagcagtcaaattataatgaaaaggtcatgtacgtagaagggactgcagttgtgatgggttttgaagatcccatgctacagacagatgacactcctattaaacgctgtctgcaaaccaaatggccatacattgagttactctggaccacagatcgctctccttcactaaattaatttgtctaagtatttataaggaagatcttaataacagatgttgaaagaaggagtcaagactggcaattggctggattaagctaaacactggtatcactgattaactgtaaataacaattaaaaacacattttcagtgtttatgatatgtttaaattatttgtcctaaagctttatgttaaagattatcctattttaccccttcgtgtgaaatttactagcaaaattaagctttcatcaaagttcatcacttttgcattcagatacttggtcatttacttaccaaattacaaacgcaatactacagcatttgtatattaagtatcacagttactattgataaactacttttgggttttatttcattgaggcactttttttattgtttgaatgattccggcttgtaatatatcagcctctacaatgaaatgcagaagagttcatttttctaagatctgtttttcattagaaatattgacaaataacacattgtcaacctggatcctttgacaatttacttaactctggcatgttcacaaaaagtagaaactctaagagaccattaccatttattcacagatgtataggggatgtattctaaaaactgacagaaaagagaatctgatagtcaacactgttaacttttactgtgtaattgccaaatacacttttccaaatttgtcccaacagccctgtaagccagctttcttctatatttataaacacgataaatgcatgagaagatctgttattacattagtatattacgttatttattatgatcctagttgatggcctaaataaacacctttttctttaa

SEQ ID NO: 307356 - DNA, 2475 bp, Homo sapiens
agtcggaagtggcaccagcacttccggtacggaaaactcgctgctgccccaacctggcttgacaggcttggtctctgcaagtggctctcagccccttcttctttcctgcctcaccttccaattcgtttgccgccgccgtcccgcagctgctgtttccggagttgccccttccccatgttccggggcaggagtccgcaaagcgaagatccgcccgccggttcctcatcatgtccgaactgactaaagagctgatggagctggtgtggggcaccaagagcagccccggtctctcggacaccattttctgccgctggacgcaagggtttgtgtttagtgaatcagagggatctgcattagaacagtttgaaggtggcccctgtgctgttattgcacctgttcaggcatttcttttgaagaagctcctgttttcttcggagaagtcttcttggcgggattgttcagaggaagagcagaaggaactcctttgtcataccttgtgtgatattttagaaagtgcttgttgtgaccactctggatcatactgcttggtttcatggttaagaggaaagacaactgaggaaactgctagtatttctgggagtcctgcagagtctagttgccaagtggaacattcttctgccttggctgtcgaagagcttggctttgagcgatttcatgcattaattcaaaggccactctattctttaaataactgtatattattgaagaatttactgatgccagacagttcacctaagagatgaagaggttccctgccaaaaaaagatcgttcagaagtttaccagaattaaaagatgctgtcttggaccagtattcaatgtggggaaataaatttggagtattgctttttctgtattctgtattactgacaaagggcattgaaaacataaaaaacgaaattgaagatgcaagtgaacccttgatagatcctgtatatggacatggcagccaaagtttaattaatctcctgctgacgggacatgctgtttctaatgtatgggatggtgatagagagtgctcaggaatgaaacttcttggtatacatgaacaagcagcagtaggatttttaacactaatggaagctttaagatactgtaaggttggttcttacttgaaatctccaaaattccctatttggattgttggcagtgagactcacctcaccgtattttttgccaaggatatggctttagttgcccctgaagctccttcagaacaagccagaagagtttttcaaacctacgacccagaagataatggattcatacccgattcacttctggaagatgtgatgaaagcattggaccttgtttcagatcctgaatatataaatctcatgaagaataaattagatccagaaggattaggaatcatattattgggcccatttcttcaagaattttttcctgatcagggctccagtggtccagaatcttttactgtctaccactacaatggattgaagcagtcaaattataatgaaaaggtcatgtacgtagaagggactgcagttgtgatgggttttgaagatcccatgctacagacagatgacactcctattaaacgctgtctgcaaaccaaatggccatacattgagttactctggaccacagatcgctctccttcactaaattaatttgtctaagtatttataaggaagatcttaataacagatgttgaaagaaggagtcaagactggcaattggctggattaagctaaacactggtatcactgattaactgtaaataacaattaaaaacacattttcagtgtttatgatatgtttaaattatttgtcctaaagctttatgttaaagattatcctattttaccccttcgtgtgaaatttactagcaaaattaagctttcatcaaagttcatcacttttgcattcagatacttggtcatttacttaccaaattacaaacgcaatactacagcatttgtatattaagtatcacagttactattgataaactacttttgggttttatttcattgaggcactttttttattgtttgaatgattccggcttgtaatatatcagcctctacaatgaaatgcagaagagttcatttttctaagatctgtttttcattagaaatattgacaaataacacattgtcaacctggatcctttgacaatttacttaactctggcatgttcacaaaaagtagaaactctaagagaccattaccatttattcacagatgtataggggatgtattctaaaaactgacagaaaagagaatctgatagtcaacactgttaacttttactgtgtaattgccaaatacacttttccaaatttgtcccaacagccctgtaagccagctttcttctatatttataaacacgataaatgcatgagaagatctgttattacattagtatattacgttatttattatgatcctagttgatggcctaaataaacacctttttctttaa

SEQ ID NO: 307357 - DNA, 2312 bp, Homo sapiens
agtcggaagtggcaccagcacttccggtacggaaaactcgctgctgccccaacctggcttgacaggcttggtctctgcaagtggctctcagccccttcttctttcctgcctcaccttccaattcgtttgccgccgccgtcccgcagctgctgtttccggagttgccccttccccatgttccggggcaggagtccgcaaagcgaagatccgcccgccggttcctcatcatgtccgaactgactaaagagctgatggagctggtgtggggcaccaagagcagccccggtctctcggacaccattttctgccgctggacgcaagggtttgtgtttagtgaatcagagggatctgcattagaacagtttgaaggtggcccctgtgctgttattgcacctgttcaggcatttcttttgaagaagctcctgttttcttcggagaagtcttcttggcgggattgttcagaggaagagcagaaggaactcctttgtcataccttgtgtgatattttagaaagtgcttgttgtgaccactctggatcatactgcttggtttcatggttaagaggaaagacaactgaggaaactgctagtatttctgggagtcctgcagagtctagttgccaagtggaacattcttctgccttggctgtcgaagagcttggctttgagcgatttcatgcattaattcaaaaaagatcgttcagaagtttaccagaattaaaagatgctgtcttggaccagtattcaatgtggggaaataaatttggagtattgctttttctgtattctgtattactgacaaagggcattgaaaacataaaaaacgaaattgaagatgcaagtgaacccttgatagatcctgtatatggacatggcagccaaagtttaattaatctcctgctgacgggacatgctgtttctaatgtatgggatggtgatagagagtgctcaggaatgagttggttcttacttgaaatctccaaaattccctatttggattgttggcagtgagactcacctcaccgtattttttgccaaggatatggctttagttgcccctgaagctccttcagaacaagccagaagagtttttcaaacctacgacccagaagataatggattcatacccgattcacttctggaagatgtgatgaaagcattggaccttgtttcagatcctgaatatataaatctcatgaagaataaattagatccagaaggattaggaatcatattattgggcccatttcttcaagaattttttcctgatcagggctccagtggtccagaatcttttactgtctaccactacaatggattgaagcagtcaaattataatgaaaaggtcatgtacgtagaagggactgcagttgtgatgggttttgaagatcccatgctacagacagatgacactcctattaaacgctgtctgcaaaccaaatggccatacattgagttactctggaccacagatcgctctccttcactaaattaatttgtctaagtatttataaggaagatcttaataacagatgttgaaagaaggagtcaagactggcaattggctggattaagctaaacactggtatcactgattaactgtaaataacaattaaaaacacattttcagtgtttatgatatgtttaaattatttgtcctaaagctttatgttaaagattatcctattttaccccttcgtgtgaaatttactagcaaaattaagctttcatcaaagttcatcacttttgcattcagatacttggtcatttacttaccaaattacaaacgcaatactacagcatttgtatattaagtatcacagttactattgataaactacttttgggttttatttcattgaggcactttttttattgtttgaatgattccggcttgtaatatatcagcctctacaatgaaatgcagaagagttcatttttctaagatctgtttttcattagaaatattgacaaataacacattgtcaacctggatcctttgacaatttacttaactctggcatgttcacaaaaagtagaaactctaagagaccattaccatttattcacagatgtataggggatgtattctaaaaactgacagaaaagagaatctgatagtcaacactgttaacttttactgtgtaattgccaaatacacttttccaaatttgtcccaacagccctgtaagccagctttcttctatatttataaacacgataaatgcatgagaagatctgttattacattagtatattacgttatttattatgatcctagttgatggcctaaataaacacctttttctttaa

SEQ ID NO: 307358 - DNA, 2438 bp, Homo sapiens
agtcggaagtggcaccagcacttccggtacggaaaactcgctgctgccccaacctggcttgacaggcttggtctctgcaagtggctctcagccccttcttctttcctgcctcaccttccaattcgtttgccgccgccgtcccgcagctgctgtttccggagttgccccttccccatgttccggggcaggagtccgcaaagcgaagatccgcccgccggttcctcatcatgtccgaactgactaaagagctgatggagctggtgtggggcaccaagagcagccccggtctctcggacaccattttctgccgctggacgcaagggtttgtgtttagtgaatcagagggatctgcattagaacagtttgaaggtggcccctgtgctgttattgcacctgttcaggcatttcttttgaagaagctcctgttttcttcggagaagtcttcttggcgggattgttcagaggaagagcagaaggaactcctttgtcataccttgtgtgatattttagaaagtgcttgttgtgaccactctggatcatactgcttggtttcatggttaagaggaaagacaactgaggaaactgctagtatttctgggagtcctgcagagtctagttgccaagtggaacattcttctgccttggctgtcgaagagcttggctttgagcgatttcatgcattaattcaaaaaagatcgttcagaagtttaccagaattaaaagatgctgtcttggaccagtattcaatgtggggaaataaatttggagtattgctttttctgtattctgtattactgacaaagggcattgaaaacataaaaaacgaaattgaagatgcaagtgaacccttgatagatcctgtatatggacatggcagccaaagtttaattaatctcctgctgacgggacatgctgtttctaatgtatgggatggtgatagagagtgctcaggaatgaaacttcttggtatacatgaacaagcagcagtaggatttttaacactaatggaagctttaagatactgtaaggttggttcttacttgaaatctccaaaattccctatttggattgttggcagtgagactcacctcaccgtattttttgccaaggatatggctttagttgcccctgaagctccttcagaacaagccagaagagtttttcaaacctacgacccagaagataatggattcatacccgattcacttctggaagatgtgatgaaagcattggaccttgtttcagatcctgaatatataaatctcatgaagaataaattagatccagaaggattaggaatcatattattgggcccatttcttcaagaattttttcctgatcagggctccagtggtccagaatcttttactgtctaccactacaatggattgaagcagtcaaattataatgaaaaggtcatgtacgtagaagggactgcagttgtgatgggttttgaagatcccatgctacagacagatgacactcctattaaacgctgtctgcaaaccaaatggccatacattgagttactctggaccacagatcgctctccttcactaaattaatttgtctaagtatttataaggaagatcttaataacagatgttgaaagaaggagtcaagactggcaattggctggattaagctaaacactggtatcactgattaactgtaaataacaattaaaaacacattttcagtgtttatgatatgtttaaattatttgtcctaaagctttatgttaaagattatcctattttaccccttcgtgtgaaatttactagcaaaattaagctttcatcaaagttcatcacttttgcattcagatacttggtcatttacttaccaaattacaaacgcaatactacagcatttgtatattaagtatcacagttactattgataaactacttttgggttttatttcattgaggcactttttttattgtttgaatgattccggcttgtaatatatcagcctctacaatgaaatgcagaagagttcatttttctaagatctgtttttcattagaaatattgacaaataacacattgtcaacctggatcctttgacaatttacttaactctggcatgttcacaaaaagtagaaactctaagagaccattaccatttattcacagatgtataggggatgtattctaaaaactgacagaaaagagaatctgatagtcaacactgttaacttttactgtgtaattgccaaatacacttttccaaatttgtcccaacagccctgtaagccagctttcttctatatttataaacacgataaatgcatgagaagatctgttattacattagtatattacgttatttattatgatcctagttgatggcctaaataaacacctttttctttaagatgcggcagatattatacatacatatcttcatatcacggaaataattacagcga

SEQ ID NO: 307359 - DNA, 1706 bp, Homo sapiens
agtcggaagtggcaccagcacttccggtacggaaaactcgctgctgccccaacctggcttgacaggcttggtctctgcaagtggctctcagccccttcttctttcctgcctcaccttccaattcgtttgccgccgccgtcccgcagctgctgtttccggagttgccccttccccatgttccggggcaggagtccgcaaagcgaagatccgcccgccggttcctcatcatgtccgaactgactaaagagctgatggagctggtgtggggcaccaagagcagccccggtctctcggacaccattttctgccgctggacgcaagggtttgtgtttagtgaatcagagggatctgcattagaacagtttgaaggtggcccctgtgctgttattgcacctgttcaggcatttcttttgaagaagctcctgttttcttcggagaagtcttcttggcgggattgttcagaggaagagcagaaggaactcctttgtcataccttgtgtgatattttagaaagtgcttgttgtgaccactctggatcatactgcttggtttcatggttaagaggaaagacaactgaggaaactgctagtatttctgggagtcctgcagagtctagttgccaagtggaacattcttctgccttggctgtcgaagagcttggctttgagcgatttcatgcattaattcaaaaaagatcgttcagaagtttaccagaattaaaagatgctgtcttggaccagtattcaatgtggggaaataaatttggagtattgctttttctgtattctgtattactgacaaagggcattgaaaacataaaaaacgaaattgaagatgcaagtgaacccttgatagatcctgtatatggacatggcagccaaagtttaattaatctcctgctgacgggacatgctgtttctaatgtatgggatggtgatagagagtgctcaggaatgaaacttcttggtatacatgaacaagcagcagtaggatttttaacactaatggaagctttaagatactgtaaggttggttcttacttgaaatctccaaaattccctatttggattgttggcagtgagactcacctcaccgtattttttgccaaggatatggctttagttgcccctgaagctccttcagaacaagccagaagagtttttcaaacctacgacccagaagataatggattcatacccgattcacttctggaagatgtgatgaaagcattggaccttgtttcagatcctgaatatataaatctcatgaagaataaattagatccagaaggattaggaatcatattattgggcccatttcttcaagaattttttcctgatcagggctccagtggtccagaatcttttactgtctaccactacaatggattgaagcagtcaaattataatgaaaaggtcatgtacgtagaagggactgcagttgtgatgggttttgaagatcccatgctacagacagatgacactcctattaaacgctgtctgcaaaccaaatggccatacattgagttactctggaccacagatcgctctccttcactaaattaatttgtctaagtatttataaggaagatcttaataacagatgttgaaagaaggagtcaagactggcaattggctggattaagctaaacactggtatcactgattaactgtaaataacaattaaaaacacattttcagtgttta

SEQ ID NO: 307360 - DNA, 1130 bp, Homo sapiens
ttcgtatcacgtctcgtaccccaccactcctatagatcagtaggaatcatattattgggcccatttcttcaagaattttttcctgatcagggctccagtggtccagaatcttttactgtctaccactacaatggattgaagcagtcaaattataatgaaaaggtcatgtacgtagaagggactgcagttgtgatgggttttgaagatcccatgctacagacagatgacactcctattaaacgctgtctgcaaaccaaatggccatacattgagttactctggaccacagatcgctctccttcactaaattaatttgtctaagtatttataaggaagatcttaataacagatgttgaaagaaggagtcaagactggcaattggctggattaagctaaacactggtatcactgattaactgtaaataacaattaaaaacacattttcagtgtttatgatatgtttaaattatttgtcctaaagctttatgttaaagattatcctattttaccccttcgtgtgaaatttactagcaaaattaagctttcatcaaagttcatcacttttgcattcagatacttggtcatttacttaccaaattacaaacgcaatactacagcatttgtatattaagtatcacagttactattgataaactacttttgggttttatttcattgaggcactttttttattgtttgaatgattccggcttgtaatatatcagcctctacaatgaaatgcagaagagttcatttttctaagatctgtttttcattagaaatattgacaaataacacattgtcaacctggatcctttgacaatttacttaactctggcatgttcacaaaaagtagaaactctaagagaccattaccatttattcacagatgtataggggatgtattctaaaaactgacagaaaagagaatctgatagtcaacactgttaacttttactgtgtaattgccaaatacacttttccaaatttgtcccaacagccctgtaagccagctttcttctatatttataaacacgataaatgcatgagaagatctgttattacattagtatattacgttatttattatgatcctagttgatggcctaaataaacacctttttctttaa

SEQ ID NO: 307361 - DNA, 1216 bp, Homo sapiens
aaagaaggacagacagacagatgaacttgggatatggctttagttgcccctgaagctccttcagaacaagccagaagagtttttcaaacctacgacccagaagataatggattcatacccgattcacttctggaagatgtgatgaaagcattggaccttgtttcagatcctgaataggctccagtggtccagaatcttttactgtctaccactacaatggattgaagcagtcaaattataatgaaaaggtcatgtacgtagaagggactgcagttgtgatgggttttgaagatcccatgctacagacagatgacactcctattaaacgctgtctgcaaaccaaatggccatacattgagttactctggaccacagatcgctctccttcactaaattaatttgtctaagtatttataaggaagatcttaataacagatgttgaaagaaggagtcaagactggcaattggctggattaagctaaacactggtatcactgattaactgtaaataacaattaaaaacacattttcagtgtttatgatatgtttaaattatttgtcctaaagctttatgttaaagattatcctattttaccccttcgtgtgaaatttactagcaaaattaagctttcatcaaagttcatcacttttgcattcagatacttggtcatttacttaccaaattacaaacgcaatactacagcatttgtatattaagtatcacagttactattgataaactacttttgggttttatttcattgaggcactttttttattgtttgaatgattccggcttgtaatatatcagcctctacaatgaaatgcagaagagttcatttttctaagatctgtttttcattagaaatattgacaaataacacattgtcaacctggatcctttgacaatttacttaactctggcatgttcacaaaaagtagaaactctaagagaccattaccatttattcacagatgtataggggatgtattctaaaaactgacagaaaagagaatctgatagtcaacactgttaacttttactgtgtaattgccaaatacacttttccaaatttgtcccaacagccctgtaagccagctttcttctatatttataaacacgataaatgcatgagaagatctgttattacattagtatattacgttatttattatgatcctagttgatggcctaaataaacacctttttctttaa

SEQ ID NO: 307362 - DNA, 1274 bp, Homo sapiens
gggtgtcggttcggcttctcgggtcggattccgcggtcccaacccttccccatggccgaccctgaggagttgcaggtttcttcgccgcccccgccgctccctcttctccctcctcttcagacgcctctgcagcatcttccccgggcggccagtgagtttgggctggccagttccgagcaggagcagcggccaacggtggaccagctggaggaagtggagctgcagatcggagacggctccagtggtccagaatcttttactgtctaccactacaatggattgaagcagtcaaattataatgaaaaggtcatgtacgtagaagggactgcagttgtgatgggttttgaagatcccatgctacagacagatgacactcctattaaacgctgtctgcaaaccaaatggccatacattgagttactctggaccacagatcgctctccttcactaaattaatttgtctaagtatttataaggaagatcttaataacagatgttgaaagaaggagtcaagactggcaattggctggattaagctaaacactggtatcactgattaactgtaaataacaattaaaaacacattttcagtgtttatgatatgtttaaattatttgtcctaaagctttatgttaaagattatcctattttaccccttcgtgtgaaatttactagcaaaattaagctttcatcaaagttcatcacttttgcattcagatacttggtcatttacttaccaaattacaaacgcaatactacagcatttgtatattaagtatcacagttactattgataaactacttttgggttttatttcattgaggcactttttttattgtttgaatgattccggcttgtaatatatcagcctctacaatgaaatgcagaagagttcatttttctaagatctgtttttcattagaaatattgacaaataacacattgtcaacctggatcctttgacaatttacttaactctggcatgttcacaaaaagtagaaactctaagagaccattaccatttattcacagatgtataggggatgtattctaaaaactgacagaaaagagaatctgatagtcaacactgttaacttttactgtgtaattgccaaatacacttttccaaatttgtcccaacagccctgtaagccagctttcttctatatttataaacacgataaatgcatgagaagatctgttattacattagtatattacgttatttattatgatcctagttgatggcctaaataaacacctttttctttaa

SEQ ID NO: 307363 - DNA, 1677 bp, Homo sapiens
agtcggaagtggcaccagcacttccggtacggaaaactcgctgctgccccaacctggcttgacaggcttggtctctgcaagtggctctcagccccttcttctttcctgcctcaccttccaattcgtttgccgccgccgtcccgcagctgctgtttccggagttgccccttccccatgttccggggcaggagtccgcaaagcgaagatccgcccgccggttcctcatcatgtccgaactgactaaagagctgatggagctggtgtggggcaccaagagcagccccggtctctcggacaccattttctgccgctggacgcaagggtttgtgtttagtgaatcagagggatctgcattagaacagtttgaaggtggcccctgtgctgttattgcacctgttcaggcatttcttttgaagaagctcctgttttcttcggagaagtcttcttggcgggattgttcagaggaagagcagaaggaactcctttgtcataccttgtgtgatattttagaaagtgcttgttgtgaccactctggatcatactgcttggtttcatggttaagaggaaagacaactgaggaaactgctagtatttctgggagtcctgcagagtctagttgccaagtggaacattcttctgccttggctgtcgaagagcttggctttgagcgatttcatgcattaattcaaaaaagatcgttcagaagtttaccagaattaaaagatgctgtcttggaccagtattcaatgtggggaaataaatttggagtattgctttttctgtattctgtattactgacaaagggcattgaaaacataaaaaacgaaattgaagatgcaagtgaacccttgatagatcctgtatatggacatggcagccaaagtttaattaatctcctgctgacgggacatgctgtttctaatgtatgggatggtgatagagagtgctcaggaatgaaacttcttggtatacatgaacaagcagcagtaggatttttaacactaatggaagctttaagatactgtaaggttggttcttacttgaaatctccaaaattccctatttggattgttggcagtgagactcacctcaccgtattttttgccaaggatatggctttagttgcccctgaagctccttcagaacaagccagaagagtttttcaaacctacgacccagaagataatggattcatacccgattcacttctggaagatgtgatgaaagcattggaccttgtttcagatcctgaatagtaagctaaataggaagtgttatttagccaactcaaaaagattcgattaagtttaagacatattgtacattttttgcctttttaaaaatctatatctgcatatatgaagcatagcaatctatgtaaggcaaagattaagaaatcgaactaatccaatattatagcagacttgacatacttaaattgagtttcctttcccacccagcaattactgtcctgctttttaaaaaatgctaaaagtgtctttctataaactttaaaaagtttctctgcaaacacttccccacgtcttaaaattttatgtgacattagtatcttcagtaaagtaatgacggttctgtgtagatggtgctagttgccctgcttaaataaccagcaggcctctgactttccctcttaaataaagatgatcaaagataaaa

SEQ ID NO: 307364 - DNA, 851 bp, Homo sapiens
agtcggaagtggcaccagcacttccggtacggaaaactcgctgctgccccaacctggcttgacaggcttggtctctgcaagtggctctcagccccttcttctttcctgcctcaccttccaattcgtttgccgccgccgtcccgcagctgctgtttccggagttgccccttccccatgttccggggcaggagtccgcaaagcgaagatccgcccgccggttcctcatcatgtccgaactgactaaagagctgatggagctggtgtggggcaccaagagcagccccggtctctcggacaccattttctgccgctggacgcaagggtttgtgtttagtgaatcagagggatctgcattagaacagtttgaaggtggcccctgtgctgttattgcacctgttcaggcatttcttttgaagaagctcctgttttcttcggagaagtcttcttggcgggattgttcagaggaagagcagaaggaactcctttgtcataccttgtgtgatattttagaaagtgcttgttgtgaccactctggatcatactgcttggtttcatggttaagaggaaagacaactgaggaaactgctagtatttctgggagtcctgcagagtctagttgccaagtggaacattcttgtaagatatatttttatttcctgaagtttttttcttgttcctttgttttaatgaatctattgaatattttgaagaaaaaattacttaaaattttcataacatgtattcttttccagcttaagcttaattactgagcctcactattttttatttccatatcatttattttaactacttagaagatactacatttttgcaaaaaaaaatgcatctct

SEQ ID NO: 307365 - DNA, 3316 bp, Homo sapiens
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctggacggggccgaggccagtggctgcaggtgctgggagggggcttctcttacctggacatcagcctctgtgtggggctctattccctgtccttcatgggcctgctggccatgtacacctacttccaggccaagataagggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcaggaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaa

SEQ ID NO: 307366 - DNA, 6013 bp, Homo sapiens
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctggacggggccgaggccagtggctgcaggtgctgggagggggcttctcttacctggacatcagcctctgtgtggggctctattccctgtccttcatgggcctgctggccatgtacacctacttccaggccaagataagggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcaggaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaaaggcaagcattggtgtgttctttaacttgctacttggagacctagtgtccagtctggacagaatgcacagagaccagcctcacctggaatgacgttcagctcggtacccctcctcagcagacgcagctcctggccacagactgcccatagaactgtctgcacccaaaccccatggccttttcatgcacggagacaggcctctggatgtgcagccttgccaccccctgccccaatcctccctgagagctcctgcctcagtgccctgggctggtgagggagaagcctgtctgcacctgcctaattccagctcctccaggaagcaagggcttgtttgtcagagctgcagggttggccactcggtggggaggagtcagccaggattagagagcctgcccctaatccggcctgctgggttttacaaggatcagagctgctgataatgaacctcattaagggggagcaggagcctcaatccgatttggttttctctttgacatcttcactctgctcagatggcctgggtgctatgtggagcaggtgggatgccaaggccactcctgctatggggcagctggggctggggagggatggcagtctccctgcatgtttccctcgacctctttagctgcagcgccttgctgggctcctgggttggactccctctctgtgcccctgctccaggcacccattggctccatcctcctggttgtgctctgcaccccctgctcccttgggctggccctggctgggggcctgagagacagacaggaacccacaatcaggaggcaaccctggcctgcaagaggaagacagaggctcccagggccggtgccctgtgtgcccactgcaccaaggccgctgaataagcctgcccttcaccccctaagggctccttgcccaatgccaagtgctggggatttctgtcagcaagccctgtggctccagtgacggtatttctaaagccaaacttagttacctagaattagcgccatgttggaaacactgtcgcagcagcccgggctgcacagtgtgtagcccagcctccaggtccacggagtggtgtggacctcccacctcacagctgcctctggcagccaagcctcttttcgcccggccccagcccctctggttgataaacgggtgggcctcctcagcagcgtggctgcctttcaccttgatttccccagggctctcggcaacatcgataaaccagcctcgcccaccagctgggccctcccccacccagtctgccaggctgggagctggagcttgctgagtcttgaatgcccttctagatggcttctctagaggctctcctggcaagagagggtcccaaggggagccctgcaaagcaaaggctccttgtctggggcgggatagagaatctcgcctctgtctggtgtgttacctactgggggcacaggaacaatttcctcaaggagacagtggcatggagctttgaaagacgagtaggtgttagcaaggaaataaggaggaacgggggttacgggcagaggagaaagcacatgccaagtcagcaaagaaaagtagaattcgaaaactttttaaaaatattactaaggattttcacaatgctgcactgggctagaaactgaagctaaaacagatacgtggtccctgctgctatggggcttccgttctagaggcaaggacaggttgtgatgagggttctgaaggatagagaccaagcagggagggtgttgaggaggcttctgcgagacctgaaggatgggaagccaggaagtgggaggggtgggggtccaggctggaggggcccaatgtaggtgtagagggactacagccctgaggggctgctccatgcggcattcttggaggtccaagaggggcagcgccaccttgggccaggctcctctccagcagccttggtatggggtgggggtgggaagacccctgatgcagcctgtcctctgggtgtgggggtggaggagagggctccaggggacccagccagccttgaccctggaggaaagtcaggtgggctcagagagagccctcaaatctgggccctgggtcagggtggggtcaagtccagccttgaagagaatggactctggaatctgacgtctgggtttgaatccagcttccaacactcactggctgtgtgactttgggcaagataacttatcctcttgtccccatgtgtcattggagataaactacccacctaccagattgttgtaccatgctgggcaaacactaagtgcttaataatggtagcccactgctcatgtcgtgtcgtctcctgtcttgatacctgaaaactcaaggggccctgttgtgcttggaggggggtgccgttcccacaggatattctgtgaagggtgtccctggagctgggcctccaggtggcaagccccaagccaccccggcaggtgccactggccagagttgaactgaggtgttgagtggaaagtgcctccccacccccatctgccacagtagtatggatttccttcatgagatggggctcctaaaatgcctgaaatgtgtatgctgttggagaattgatgtgtatgatttattgaactttgcactcatttaaatctcatttaatcctccaacaacgcaagatgaagaagctgaggcttaaagagattaagaaacatcctatcccctttactcccaccaaaataaatacatttgccctattctccc

SEQ ID NO: 307367 - DNA, 5678 bp, Homo sapiens
  misc_feature (5608)..(5608): n is a, c, g, or t
  misc_feature (5615)..(5615): n is a, c, g, or t
  misc_feature (5619)..(5619): n is a, c, g, or t
  misc_feature (5627)..(5627): n is a, c, g, or t
  misc_feature (5630)..(5630): n is a, c, g, or t
  misc_feature (5633)..(5633): n is a, c, g, or t
  misc_feature (5635)..(5635): n is a, c, g, or t
  misc_feature (5638)..(5638): n is a, c, g, or t
  misc_feature (5645)..(5645): n is a, c, g, or t
  misc_feature (5659)..(5659): n is a, c, g, or t
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctggacggggccgaggccagtggctgcaggtgctgggagggggcttctcttacctggacatcagcctctgtgtggggctctattccctgtccttcatgggcctgctggccatgtacacctacttccaggccaagataagggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcaggaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaaaggcaagcattggtgtgttctttaacttgctacttggagacctagtgtccagtctggacagaatgcacagagaccagcctcacctggaatgacgttcagctcggtacccctcctcagcagacgcagctcctggccacagactgcccatagaactgtctgcacccaaaccccatggccttttcatgcacggagacaggcctctggatgtgcagccttgccaccccctgccccaatcctccctgagagctcctgcctcagtgccctgggctggtgagggagaagcctgtctgcacctgcctaattccagctcctccaggaagcaagggcttgtttgtcagagctgcagggttggccactcggtggggaggagtcagccaggattagagagcctgcccctaatccggcctgctgggttttacaaggatcagagctgctgataatgaacctcattaagggggagcaggagcctcaatccgatttggttttctctttgacatcttcactctgctcagatggcctgggtgctatgtggagcaggtgggatgccaaggccactcctgctatggggcagctggggctggggagggatggcagtctccctgcatgtttccctcgacctctttagctgcagcgccttgctgggctcctgggttggactccctctctgtgcccctgctccaggcacccattggctccatcctcctggttgtgctctgcaccccctgctcccttgggctggccctggctgggggcctgagagacagacaggaacccacaatcaggaggcaaccctggcctgcaagaggaagacagaggctcccagggccggtgccctgtgtgcccactgcaccaaggccgctgaataagcctgcccttcaccccctaagggctccttgcccaatgccaagtgctggggatttctgtcagcaagccctgtggctccagtgacggtatttctaaagccaaacttagttacctagaattagcgccatgttggaaacactgtcgcagcagcccgggctgcacagtgtgtagcccagcctccaggtccacggagtggtgtggacctcccacctcacagctgcctctggcagccaagcctcttttcgcccggccccagcccctctggttgataaacgggtgggcctcctcagcagcgtggctgcctttcaccttgatttccccagggctctcggcaacatcgataaaccagcctcgcccaccagctgggccctcccccacccagtctgccaggctgggagctggagcttgctgagtcttgaatgcccttctagatggcttctctagaggctctcctggcaagagagggtcccaaggggagccctgcaaagcaaaggctccttgtctggggcgggatagagaatctcgcctctgtctggtgtgttacctactgggggcacaggaacaatttcctcaaggagacagtggcatggagctttgaaagacgagtaggtgttagcaaggaaataaggaggaacgggggttacgggcagaggagaaagcacatgccaagtcagcaaagaaaagtagaattcgaaaactttttaaaaatattactaaggattttcacaatgctgcactgggctagaaactgaagctaaaacagatacgtggtccctgctgctatggggcttccgttctagaggcaaggacaggttgtgatgagggttctgaaggatagagaccaagcagggagggtgttgaggaggcttctgcgagacctgaaggatgggaagccaggaagtgggaggggtgggggtccaggctggaggggcccaatgtaggtgtagagggactacagccctgaggggctgctccatgcggcattcttggaggtccaagaggggcagcgccaccttgggccaggctcctctccagcagccttggtatggggtgggggtgggaagacccctgatgcagcctgtcctctgggtgtgggggtggaggagagggctccaggggacccagccagccttgaccctggaggaaagtcaggtgggctcagagagagccctcaaatctgggccctgggtcagggtggggtcaagtccagccttgaagagaatggactctggaatctgacgtctgggtttgaatccagcttccaacactcactggctgtgtgactttgggcaagataacttatcctcttgtccccatgtgtcattggagataaactacccacctaccagattgttgtaccatgctgggcaaacactaagtgcttaataatggtagcccactgctcaaaaaaaaaaaaaaaaaaaaaanaaaaaanaaanaaaaaaanaanaananaanaaacaanaaagaaaaaaaaanaaaaaaaaaaaaggggggg

SEQ ID NO: 307368 - DNA, 2579 bp, Homo sapiens
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacccttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaa

SEQ ID NO: 307369 - DNA, 4445 bp, Homo sapiens
  misc_feature (3338)..(3338): n is a, c, g, or t
  misc_feature (3345)..(3345): n is a, c, g, or t
  misc_feature (3349)..(3349): n is a, c, g, or t
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctggacggggccgaggccagtggctgcaggtgctgggagggggcttctcttacctggacatcagcctctgtgtggggctctattccctgtccttcatgggcctgctggccatgtacacctacttccaggccaagataagggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcaggaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaaaaaaaaaaaaaaaaaaaaaaanaaaaaanaaanaaaaaaaaaaaaaaaaatagtaggagtgagcggcgcggcgcacattataattatctcctcccttagagaggcgcccgacaatagctatattcgacgctagctccaccgcatattattgttagacaacaagggggcgcctcctactataggagagcgcgatcatatttatatgacaagtaagcaacgacgggcgcccgtcgattaatacacagagatctgtaatcagtgtggagagacaaagcgggatcaacctagctgtgggcgacaccttctgtgtggagaaaaggaagaaccctctatcctctgctctgtgtgaggagagcgtgaacaatatatgtgtgatgtcaaacaactatctccactgaagagaaaaaatcttaacacgctcctctactacgggaaactatatctatatattacgaatcttattcacaaagagagggtgagaaatcaaacacagcggtgtgatgcatacacacaaaccacaccccagcgcgcagcatgatgtatttatgcgcaccgctgcgcaggagagctatgtgcagacaacagatatctgtgtgctgcaggtgcaatctcaccacctgatgcgacaatattatatgatcatcctttaatacgcagaagcaaaatatattatttgtattaatatcagctcgcgagggcgcgacgcatacacgtgtagatgaatatatacggagagataaactgcatccgcttgactcgctgttgtgtgttggcttgattaggtcgaactaatatggagccatagagacacaaagaccataggacggcgttgaaggaggaatatgagctatactgcgtatgtatccgctgcgtgttcatgatgttcgctgagaagaatgaaaagcgtatcaatatggcatcgtaacagagaacattgtcagggagtgggtgtgtcgggtgactgagaaaaagtaacaaataggtgaaaaaagagaggatgagcatacatacaagttggtgtagatgctgtttagtgaagagtgagagatagaaatataaatatagaagtaagataaataaatagtaaagagtatcataactgaagagtgcagatgaacggagtgcgtgg

SEQ ID NO: 307370 - DNA, 3782 bp, Homo sapiens
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctggacggggccgaggccagtggctgcaggtgctgggagggggcttctcttacctggacatcagcctctgtgtggggctctattccctgtccttcatgggcctgctggccatgtacacctacttccaggccaagataagggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcaggaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaaaggcaagcattggtgtgttctttaacttgctacttggagacctagtgtccagtctggacagaatgcacagagaccagcctcacctggaatgacgttcagctcggtacccctcctcagcagacgcagctcctggccacagactgcccatagaactgtctgcacccaaaccccatggccttttcatgcacggagacaggcctctggatgtgcagccttgccaccccctgccccaatcctccctgagagctcctgcctcagtgccctgggctggtgagggagaagcctgtctgcacctgcctaattccagctcctccaggaagcaagggcttgtttgtcagagctgcagggttggccactcggtggggaggagtcagccaggattagagagcctgcccctaatccggcctgctgggttttacaaggatcagagctgcgtctgctgaggaggggatccgctagatcacct

SEQ ID NO: 307371 - DNA, 5436 bp, Homo sapiens
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctggacggggccgaggccagtggctgcaggtgctgggagggggcttctcttacctggacatcagcctctgtgtggggctctattccctgtccttcatgggcctgctggccatgtacacctacttccaggccaagataagggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcaggaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaaaggcaagcattggtgtgttctttaacttgctacttggagacctagtgtccagtctggacagaatgcacagagaccagcctcacctggaatgacgttcagctcggtacccctcctcagcagacgcagctcctggccacagactgcccatagaactgtctgcacccaaaccccatggccttttcatgcacggagacaggcctctggatgtgcagccttgccaccccctgccccaatcctccctgagagctcctgcctcagtgccctgggctggtgagggagaagcctgtctgcacctgcctaattccagctcctccaggaagcaagggcttgtttgtcagagctgcagggttggccactcggtggggaggagtcagccaggattagagagcctgcccctaatccggcctgctgggttttacaaggatcagagctgctgataatgaacctcattaagggggagcaggagcctcaatccgatttggttttctctttgacatcttcactctgctcagatggcctgggtgctatgtggagcaggtgggatgccaaggccactcctgctatggggcagctggggctggggagggatggcagtctccctgcatgtttccctcgacctctttagctgcagcgccttgctgggctcctgggttggactccctctctgtgcccctgctccaggcacccattggctccatcctcctggttgtgctctgcaccccctgctcccttgggctggccctggctgggggcctgagagacagacaggaacccacaatcaggaggcaaccctggcctgcaagaggaagacagaggctcccagggccggtgccctgtgtgcccactgcaccaaggccgctgaataagcctgcccttcaccccctaagggctccttgcccaatgccaagtgctggggatttctgtcagcaagccctgtggctccagtgacggtatttctaaagccaaacttagttacctagaattagcgccatgttggaaacactgtcgcagcagcccgggctgcacagtgtgtagcccagcctccaggtccacggagtggtgtggacctcccacctcacagctgcctctggcagccaagcctcttttcgcccggccccagcccctctggttgataaacgggtgggcctcctcagcagcgtggctgcctttcaccttgatttccccagggctctcggcaacatcgataaaccagcctcgcccaccagctgggccctcccccacccagtctgccaggctgggagctggagcttgctgagtcttgaatgcccttctagatggcttctctagaggctctcctggcaagagagggtcccaaggggagccctgcaaagcaaaggctccttgtctggggcgggatagagaatctcgcctctgtctggtgtgttacctactgggggcacagcctggaggaaagtcaggtgggctcagagagagccctcaaatctgggccctgggtcagggtggggtcaagtccagccttgaagagaatggactctggaatctgacgtctgggtttgaatccagcttccaacactcactggctgtgtgactttgggcaagataacttatcctcttgtccccatgtgtcattggagataaactacccacctaccagattgttgtaccatgctgggcaaacactaagtgcttaataatggtagcccactgctcatgtcgtgtcgtctcctgtcttgatacctgaaaactcaaggggccctgttgtgcttggaggggggtgccgttcccacaggatattctgtgaagggtgtccctggagctgggcctccaggtggcaagccccaagccaccccggcaggtgccactggccagagttgaactgaggtgttgagtggaaagtgcctccccacccccatctgccacagtagtatggatttccttcatgagatggggctcctaaaatgcctgaaatgtgtatgctgttggagaattgatgtgtatgatttattgaactttgcactcatttaaatctcatttaatcctccaacaacgcaagatgaagaagctgaggcttaaagagattaagaaacatcctatcccctttactcccaccaaaataaatacatttgccctattctccc

SEQ ID NO: 307372 - DNA, 5227 bp, Homo sapiens
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctggacggggccgaggccagtggctgcaggtgctgggagggggcttctcttacctggacatcagcctctgtgtggggctctattccctgtccttcatgggcctgctggccatgtacacctacttccaggccaagataagggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcaggaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaaaggcaagcattggtgtgttctttaacttgctacttggagacctagtgtccagtctggacagaatgcacagagaccagcctcacctggaatgacgttcagctcggtacccctcctcagcagacgcagctcctggccacagactgcccatagaactgtctgcacccaaaccccatggccttttcatgcacggagacaggcctctggatgtgcagccttgccaccccctgccccaatcctccctgagagctcctgcctcagtgccctgggctggtgagggagaagcctgtctgcacctgcctaattccagctcctccaggaagcaagggcttgtttgtcagagctgcagggttggccactcggtggggaggagtcagccaggattagagagcctgcccctaatccggcctgctgggttttacaaggatcagagctgctgataatgaacctcattaagggggagcaggagcctcaatccgatttggttttctctttgacatcttcactctgctcagatggcctgggtgctatgtggagcaggtgggatgccaaggccactcctgctatggggcagctggggctggggagggatggcagtctccctgcatgtttccctcgacctctttagctgcagcgccttgctgggctcctgggttggactccctctctgtgcccctgctccaggcacccattggctccatcctcctggttgtgctctgcaccccctgctcccttgggctggccctggctgggggcctgagagacagacaggaacccacaatcaggaggcaaccctggcctgcaagaggaagacagaggctcccagggccggtgccctgtgtgcccactgcaccaaggccgctgaataagcctgcccttcaccccctaagggctccttgcccaatgccaagtgctggggatttctgtcagcaagccctgtggctccagtgacggtatttctaaagccaaacttagttacctagaattagcgccatgttggaaacactgtcgcagcagcccgggctgcacagtgtgtagcccagcctccaggtccacggagtggtgtggacctcccacctcacagctgcctctggcagccaagcctcttttcgcccggccccagcccctctggttgataaacgggtgggcctcctcagcagcgtggctgcctttcaccttgatttccccagggctctcggcaacatcgataaaccagccctggaggaaagtcaggtgggctcagagagagccctcaaatctgggccctgggtcagggtggggtcaagtccagccttgaagagaatggactctggaatctgacgtctgggtttgaatccagcttccaacactcactggctgtgtgactttgggcaagataacttatcctcttgtccccatgtgtcattggagataaactacccacctaccagattgttgtaccatgctgggcaaacactaagtgcttaataatggtagcccactgctcatgtcgtgtcgtctcctgtcttgatacctgaaaactcaaggggccctgttgtgcttggaggggggtgccgttcccacaggatattctgtgaagggtgtccctggagctgggcctccaggtggcaagccccaagccaccccggcaggtgccactggccagagttgaactgaggtgttgagtggaaagtgcctccccacccccatctgccacagtagtatggatttccttcatgagatggggctcctaaaatgcctgaaatgtgtatgctgttggagaattgatgtgtatgatttattgaactttgcactcatttaaatctcatttaatcctccaacaacgcaagatgaagaagctgaggcttaaagagattaagaaacatcctatcccctttactcccaccaaaataaatacatttgccctattctccc

SEQ ID NO: 307373 - DNA, 3334 bp, Homo sapiens
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtcctttgccacttgcggtttgctgctcgccttctgtctagtgtccgaccgtgcaggccctccagcttgcgcacgtgtgccgtggtcttaccacagctgtcacgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctggacggggccgaggccagtggctgcaggtgctgggagggggcttctcttacctggacatcagcctctgtgtggggctctattccctgtccttcatgggcctgctggccatgtacacctacttccaggccaagataagggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcaggaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaa

SEQ ID NO: 307374 - DNA, 3155 bp, Homo sapiens
caatgcggagagactgaggctcagtgagaatgaggcaggattcaaataagctgaaaaacaggaatgtggtgctaagaggccaggactgagctgccctatgcccactgcccggggctgccctccctgcacagcaggggaacctggaccctgctcctgtcttttgtgtcaaaggagctctctgtcctagcaaccccaagaagcttcagttgggggacaggctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctggacggggccgaggccagtggctgcaggtgctgggagggggcttctcttacctggacatcagcctctgtgtggggctctattccctgtccttcatgggcctgctggccatgtacacctacttccaggccaagataagggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcaggaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaa

SEQ ID NO: 307375 - DNA, 3164 bp, Homo sapiens
  misc_feature (59)..(59): n is a, c, g, or t
  misc_feature (114)..(115): n is a, c, g, or t
tgctgaggtacttaagatcccggaggcaggtctcgtaaatgtaacatcacaggaagcangcaagcagaggtcctccagcccatcgaggctacgtgcactacttcttcggctgcnnagatgcgctagcacttcgagcagatgctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctggacggggccgaggccagtggctgcaggtgctgggagggggcttctcttacctggacatcagcctctgtgtggggctctattccctgtccttcatgggcctgctggccatgtacacctacttccaggccaagataagggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcaggaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaa

SEQ ID NO: 307376 - DNA, 3213 bp, Homo sapiens
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccaggctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctggacggggccgaggccagtggctgcaggtgctgggagggggcttctcttacctggacatcagcctctgtgtggggctctattccctgtccttcatgggcctgctggccatgtacacctacttccaggccaagataagggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcaggaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaa

SEQ ID NO: 307377 - DNA, 3690 bp, Homo sapiens
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctggacggggccgaggccagtggctgcaggtgctgggagggggcttctcttacctggacatcagcctctgtgtggggctctattccctgtccttcatgggcctgctggccatgtacacctacttccaggccaagataagggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcaggaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaaaggcaagcattggtgtgttctttaacttgctacttggagacctagtgtccagtctggacagaatgcacagagaccagcctcacctggaatgacgttcagctcggtacccctcctcagcagacgcagctcctggccacagactgcccatagaactgtctgcacccaaaccccatggccttttcatgcacggagacaggcctctggatgtgcagccttgccaccccctgccccaatcctccctgagagctcctgcctcagtgccctgggctggtgagggagaagcctgtctgcacctgcctaattccagctcctccaggaagcaagggcttgtttgtcagagctgcgtctgctgaggaggggtacgagctgaacgc

SEQ ID NO: 307378 - DNA, 3414 bp, Homo sapiens
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctggacggggccgaggccagtggctgcaggtgctgggagggggcttctcttacctggacatcagcctctgtgtggggctctattccctgtccttcatgggcctgctggccatgtacacctacttccaggccaagataagggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcaggaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaaattctgggcaagattaatgcttcttggcctagggatatcggtttgtttaacttctggttggtgtcaatgtccttctggtgccccctatggtcttggag

SEQ ID NO: 307379 - DNA, 3346 bp, Homo sapiens
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctggacggggccgaggccagtggctgcaggtgctgggagggggcttctcttacctggacatcagcctctgtgtggggctctattccctgtccttcatgggcctgctggccatgtacacctacttccaggccaagataagggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcaggaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaaaagcactcccccgccacaaccggaccgcca

SEQ ID NO: 307380 - DNA, 3368 bp, Homo sapiens
  misc_feature (3317)..(3317): n is a, c, g, or t
  misc_feature (3320)..(3320): n is a, c, g, or t
  misc_feature (3323)..(3323): n is a, c, g, or t
  misc_feature (3325)..(3325): n is a, c, g, or t
  misc_feature (3328)..(3328): n is a, c, g, or t
  misc_feature (3335)..(3335): n is a, c, g, or t
  misc_feature (3349)..(3349): n is a, c, g, or t
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctggacggggccgaggccagtggctgcaggtgctgggagggggcttctcttacctggacatcagcctctgtgtggggctctattccctgtccttcatgggcctgctggccatgtacacctacttccaggccaagataagggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcaggaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaanaanaananaanaaacaanaaagaaaaaaaaanaaaaaaaaaaaaggggggg

SEQ ID NO: 307381 - DNA, 2319 bp, Homo sapiens
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaa

SEQ ID NO: 307382 - DNA, 3657 bp, Homo sapiens
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctggacggggccgaggccagtggctgcaggtgctgggagggggcttctcttacctggacatcagcctctgtgtggggctctattccctgtccttcatgggcctgctggccatgtacacctacttccaggccaagataagggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcaggaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggttgtgggggtgggaagacccctgatgcagcctgtcctctgggtgtgggggtggaggagagggctccaggggacccagccagccttgaccctggaggaaagtcaggtgggctcagagagagccctcaaatctgggccctgggtcagggtggggtcaagtccagccttgaagagaatggactctggaatctgacgtctgggtttgaatccagcttccaacactcactggctgtgtgactttgggcaagataacttatcctcttgtccccatgtgtcattggagataaactacccacctaccagattgttgtaccatgctgggcaaacactaagtgcttaataatggtagcccactgctcatgtcgtgtcgtctcctgtcttgatacctgaaaactcaaggggccctgttgtgcttggaggggggtgccgttcccacaggatattctgtgaagggtgtccctggagctgggcctccaggtggcaagccccaagccaccccggcaggtgccactggccagagttgaactgaggtgttgagtggaaagtgcctccccacccccatctgccacagtagtatggatttccttcatgagatggggctcctaaaatgcctgaaatgtgtatgctgttggagaattgatgtgtatgatttattgaactttgcactcatttaaatctcatttaatcctccaacaacgcaagatgaagaagctgaggcttaaagagattaagaaacatcctatcccctttactcccaccaaaataaatacatttgccctattctccc

SEQ ID NO: 307383 - DNA, 2982 bp, Homo sapiens
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctggacggggccgaggccagtggctgcaggtgctgggagggggcttctcttacctggacatcagcctctgtgtggggctctattccctgtccttcatgggcctgctggccatgtacacctacttccaggccaagataagggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcaggaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaa

SEQ ID NO: 307384 - DNA, 4884 bp, Homo sapiens
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaaaggcaagcattggtgtgttctttaacttgctacttggagacctagtgtccagtctggacagaatgcacagagaccagcctcacctggaatgacgttcagctcggtacccctcctcagcagacgcagctcctggccacagactgcccatagaactgtctgcacccaaaccccatggccttttcatgcacggagacaggcctctggatgtgcagccttgccaccccctgccccaatcctccctgagagctcctgcctcagtgccctgggctggtgagggagaagcctgtctgcacctgcctaattccagctcctccaggaagcaagggcttgtttgtcagagctgcagggttggccactcggtggggaggagtcagccaggattagagagcctgcccctaatccggcctgctgggttttacaaggatcagagctgctgataatgaacctcattaagggggagcaggagcctcaatccgatttggttttctctttgacatcttcactctgctcagatggcctgggtgctatgtggagcaggtgggatgccaaggccactcctgctatggggcagctggggctggggagggatggcagtctccctgcatgtttccctcgacctctttagctgcagcgccttgctgggctcctgggttggactccctctctgtgcccctgctccaggcacccattggctccatcctcctggttgtgctctgcaccccctgctcccttgggctggccctggctgggggcctgagagacagacaggaacccacaatcaggaggcaaccctggcctgcaagaggaagacagaggctcccagggccggtgccctgtgtgcccactgcaccaaggccgctgaataagcctgcccttcaccccctaagggctccttgcccaatgccaagtgctggggatttctgtcagcaagccctgtggctccagtgacggtatttctaaagccaaacttagttacctagaattagcgccatgttggaaacactgtcgcagcagcccgggctgcacagtgtgtagcccagcctccaggtccacggagtggtgtggacctcccacctcacagctgcctctggcagccaagcctcttttcgcccggccccagcccctctggttgataaacgggtgggcctcctcagcagcgtggctgcctttcaccttgatttccccagggctctcggcaacatcgataaaccagcctcgcccaccagctgggccctcccccacccagtctgccaggctgggagctggagcttgctgagtcttgaatgcccttctagatggcttctctagaggctctcctggcaagagagggtcccaaggggagccctgcaaagcaaaggctccttgtctggggcgggatagagaatctcgcctctgtctggtgtgttacctactgggggcacaggaacaatttcctcaaggagacagtggcatggagctttgaaagacgagtaggtgttagcaaggaaataaggaggaacgggggttacgggcagaggagaaagcacatgccaagtcagcaaagaaaagtagaattcgaaaactttttaaaaatattactaaggattttcacaatgctgcactgggctagaaactgaagctaaaacagatacgtggtccctgctgctatggggcttccgttctagaggcaaggacaggttgtgatgagggttctgaaggatagagaccaagcagggagggtgttgaggaggcttctgcgagacctgaaggatgggaagccaggaagtgggaggggtgggggtccaggctggaggggcccaatgtaggtgtagagggactacagccctgaggggctgctccatgcggcattcttggaggtccaagaggggcagcgccaccttgggccaggctcctctccagcagccttggtatggggtgggggtgggaagacccctgatgcagcctgtcctctgggtgtgggggtggaggagagggctccaggggacccagccagccttgaccctggaggaaagtcaggtgggctcagagagagccctcaaatctgggccctgggtcagggtggggtcaagtccagccttgaagagaatggactctggaatctgacgtctgggtttgaatccagcttccaacactcactggctgtgtgactttgggcaagataacttatcctcttgtccccatgtgtcattggagataaactacccacctaccagattgttgtaccatgctgggcaaacactaagtgcttaataatggtagcccactgctcatgtcgtgtcgtctcctgtcttgatacctgaaaactcaaggggccctgttgtgcttggaggggggtgccgttcccacaggatattctgtgaagggtgtccctggagctgggcctccaggtggcaagccccaagccaccccggcaggtgccactggccagagttgaactgaggtgttgagtggaaagtgcctccccacccccatctgccacagtagtatggatttccttcatgagatggggctcctaaaatgcctgaaatgtgtatgctgttggagaattgatgtgtatgatttattgaactttgcactcatttaaatctcatttaatcctccaacaacgcaagatgaagaagctgaggcttaaagagattaagaaacatcctatcccctttactcccaccaaaataaatacatttgccctattctccc

SEQ ID NO: 307385 - DNA, 1983 bp, Homo sapiens
tgcagtgatctagaggatcccttgcatatgccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctggacggggccgaggccagtggctgcaggtgctgggagggggcttctcttacctggacatcagcctctgtgtggggctctattccctgtccttcatgggcctgctggccatgtacacctacttccaggccaagataagggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcaggaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaa

SEQ ID NO: 307386 - DNA, 2485 bp, Homo sapiens
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctggacggggccgaggccagtggctgcaggtgctgggagggggcttctcttacctggacatcagcctctgtgtggggctctattccctgtccttcatgggcctgctggccatgtacacctacttccaggccaagataagggccctgaagggccatgctggccaccctgcagcctgaaccacctggggaggaggcgggagagggagctgccatctctaggcaaataatgtctattctgtgacatctattttgtaacattatactatctgagcttgcttaaacatctacataaatgtatctatcaatatgtgcagcgtgaacctttaggttatctcttattttg

SEQ ID NO: 307387 - DNA, 1246 bp, Homo sapiens
tgcagtgatctagaggatcccttgcatatgccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacccttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaa

SEQ ID NO: 307388 - DNA, 2236 bp, Homo sapiens
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatcccctggccagtctctccacagtccccaccctccagccctgtctttggccacttgcctgtccctgagcattggtgaggatctgaatgctgatccctggcatgctgggaatggcgctggt

SEQ ID NO: 307389 - DNA, 1840 bp, Homo sapiens
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaactagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaa

SEQ ID NO: 307390 - DNA, 2216 bp, Homo sapiens
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtccttgaagagaatggactctggaatctgacgtctgggtttgaatccagcttccaacactcactggctgtgtgactttgggcaagataacttatcctcttgtccccatgtgtcattggagataaactacccacctaccagattgttgtaccatgctgggcaaacactaagtgcttaataatggtagcccactgctcatgtcgtgtcgtctcctgtcttgatacctgaaaactcaaggggccctgttgtgcttggaggggggtgccgttcccacaggatattctgtgaagggtgtccctggagctgggcctccaggtggcaagccccaagccaccccggcaggtgccactggccagagttgaactgaggtgttgagtggaaagtgcctccccacccccatctgccacagtagtatggatttccttcatgagatggggctcctaaaatgcctgaaatgtgtatgctgttggagaattgatgtgtatgatttattgaactttgcactcatttaaatctcatttaatcctccaacaacgcaagatgaagaagctgaggcttaaagagattaagaaacatcctatcccctttactcccaccaaaataaatacatttgccctattctccc

SEQ ID NO: 307391 - DNA, 1683 bp, Homo sapiens
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcgccaagaactaccaccaggactcagaggccgccatcaaccgcccagatcaacctggagctctacgcctcctacgtttacctgtccatgtcttactactgtgaccgcgatgagggatcctctagaacaccacaccag

SEQ ID NO: 307392 - DNA, 2850 bp, Homo sapiens
ctccttcaggtactgcgtgcttctctctctccggctcatccagggtaccgctgcttttccgttgggtgcagcttgctccactcggcgcccagcatcttggtgatctcgggaaagggcagatccgggtggcgcgtgctggatctgctcgcgccgctcgttcaggaagcgcacgtagcccgtgaccggtgccttgggcccattcggcaaaatcttcttccgcttcttgcccatgggccagccgcgtttcttcaccggctgcagcttcctcagcagacgcagctcctggccacagactgcccatagaactgtctgcacccaaaccccatggccttttcatgcacggagacaggcctctggatgtgcagccttgccaccccctgccccaatcctccctgagagctcctgcctcagtgccctgggctggtgagggagaagcctgtctgcacctgcctaattccagctcctccaggaagcaagggcttgtttgtcagagctgcagggttggccactcggtggggaggagtcagccaggattagagagcctgcccctaatccggcctgctgggttttacaaggatcagagctgctgataatgaacctcattaagggggagcaggagcctcaatccgatttggttttctctttgacatcttcactctgctcagatggcctgggtgctatgtggagcaggtgggatgccaaggccactcctgctatggggcagctggggctggggagggatggcagtctccctgcatgtttccctcgacctctttagctgcagcgccttgctgggctcctgggttggactccctctctgtgcccctgctccaggcacccattggctccatcctcctggttgtgctctgcaccccctgctcccttgggctggccctggctgggggcctgagagacagacaggaacccacaatcaggaggcaaccctggcctgcaagaggaagacagaggctcccagggccggtgccctgtgtgcccactgcaccaaggccgctgaataagcctgcccttcaccccctaagggctccttgcccaatgccaagtgctggggatttctgtcagcaagccctgtggctccagtgacggtatttctaaagccaaacttagttacctagaattagcgccatgttggaaacactgtcgcagcagcccgggctgcacagtgtgtagcccagcctccaggtccacggagtggtgtggacctcccacctcacagctgcctctggcagccaagcctcttttcgcccggccccagcccctctggttgataaacgggtgggcctcctcagcagcgtggctgcctttcaccttgatttccccagggctctcggcaacatcgataaaccagcctcgcccaccagctgggccctcccccacccagtctgccaggctgggagctggagcttgctgagtcttgaatgcccttctagatggcttctctagaggctctcctggcaagagagggtcccaaggggagccctgcaaagcaaaggctccttgtctggggcgggatagagaatctcgcctctgtctggtgtgttacctactgggggcacaggaacaatttcctcaaggagacagtggcatggagctttgaaagacgagtaggtgttagcaaggaaataaggaggaacgggggttacgggcagaggagaaagcacatgccaagtcagcaaagaaaagtagaattcgaaaactttttaaaaatattactaaggattttcacaatgctgcactgggctagaaactgaagctaaaacagatacgtggtccctgctgctatggggcttccgttctagaggcaaggacaggttgtgatgagggttctgaaggatagagaccaagcagggagggtgttgaggaggcttctgcgagacctgaaggatgggaagccaggaagtgggaggggtgggggtccaggctggaggggcccaatgtaggtgtagagggactacagccctgaggggctgctccatgcggcattcttggaggtccaagaggggcagcgccaccttgggccaggctcctctccagcagccttggtatggggtgggggtgggaagacccctgatgcagcctgtcctctgggtgtgggggtggaggagagggctccaggggacccagccagccttgaccctggaggaaagtcaggtgggctcagagagagccctcaaatctgggccctgggtcagggtggggtcaagtccagccttgaagagaatggactctggaatctgacgtctgggtttgaatccagcttccaacactcactggctgtgtgactttgggcaagataacttatcctcttgtccccatgtgtcattggagataaactacccacctaccagattgttgtaccatgctgggcaaacactaagtgcttaataatggtagcccactgctcatgtcgtgtcgtctcctgtcttgatacctgaaaactcaaggggccctgttgtgcttggaggggggtgccgttcccacaggatattctgtgaagggtgtccctggagctgggcctccaggtggcaagccccaagccaccccggcaggtgccactggccagagttgaactgaggtgttgagtggaaagtgcctccccacccccatctgccacagtagtatggatttccttcatgagatggggctcctaaaatgcctgaaatgtgtatgctgttggagaattgatgtgtatgatttattgaactttgcactcatttaaatctcatttaatcctccaacaacgcaagatgaagaagctgaggcttaaagagattaagaaacatcctatcccctttactcccaccaaaataaatacatttgccctattctccc

SEQ ID NO: 307393 - DNA, 910 bp, Homo sapiens
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttatatgagttggggatgcctctagagtcacctcgcaatcagcgtgcactccc

SEQ ID NO: 307394 - DNA, 1643 bp, Homo sapiens
accccgtccggacacctacattgggcccctccagcctggacccccaccccctcccacttcctggcttcccatccttcaggtctcgcagaagcctcctcagcagcgtggctgcctttcaccttgatttccccagggctctcggcaacatcgataaaccagcctcgcccaccagctgggccctcccccacccagtctgccaggctgggagctggagcttgctgagtcttgaatgcccttctagatggcttctctagaggctctcctggcaagagagggtcccaaggggagccctgcaaagcaaaggctccttgtctggggcgggatagagaatctcgcctctgtctggtgtgttacctactgggggcacaggaacaatttcctcaaggagacagtggcatggagctttgaaagacgagtaggtgttagcaaggaaataaggaggaacgggggttacgggcagaggagaaagcacatgccaagtcagcaaagaaaagtagaattcgaaaactttttaaaaatattactaaggattttcacaatgctgcactgggctagaaactgaagctaaaacagatacgtggtccctgctgctatggggcttccgttctagaggcaaggacaggttgtgatgagggttctgaaggatagagaccaagcagggagggtgttgaggaggcttctgcgagacctgaaggatgggaagccaggaagtgggaggggtgggggtccaggctggaggggcccaatgtaggtgtagagggactacagccctgaggggctgctccatgcggcattcttggaggtccaagaggggcagcgccaccttgggccaggctcctctccagcagccttggtatggggtgggggtgggaagacccctgatgcagcctgtcctctgggtgtgggggtggaggagagggctccaggggacccagccagccttgaccctggaggaaagtcaggtgggctcagagagagccctcaaatctgggccctgggtcagggtggggtcaagtccagccttgaagagaatggactctggaatctgacgtctgggtttgaatccagcttccaacactcactggctgtgtgactttgggcaagataacttatcctcttgtccccatgtgtcattggagataaactacccacctaccagattgttgtaccatgctgggcaaacactaagtgcttaataatggtagcccactgctcatgtcgtgtcgtctcctgtcttgatacctgaaaactcaaggggccctgttgtgcttggaggggggtgccgttcccacaggatattctgtgaagggtgtccctggagctgggcctccaggtggcaagccccaagccaccccggcaggtgccactggccagagttgaactgaggtgttgagtggaaagtgcctccccacccccatctgccacagtagtatggatttccttcatgagatggggctcctaaaatgcctgaaatgtgtatgctgttggagaattgatgtgtatgatttattgaactttgcactcatttaaatctcatttaatcctccaacaacgcaagatgaagaagctgaggcttaaagagattaagaaacatcctatcccctttactcccaccaaaataaatacatttgccctattctccc

SEQ ID NO: 307395 - DNA, 391 bp, Homo sapiens
gtctggtactggggtaaaggctggttgtaaagtccacatagcaggacagtgggtctggccaacaccgggaaatgactgagatggcgctcttcacgcttccctggaaaaccacggagggccggggctgaggggtaggtggatctgcctcctcctccatgctgccatctgttgagctcccactgtgggctagtgtttgtaatctgtattttctaattacccatcctctggaagggcagtggcgagccctttctgcagacaaggaagctggcgttctgagtggaggagtgtggtctgggtttttgggtgggactgatgtcaccaccagcctgtgtatgcttccctctgtaggtgcccccagcgaggacccccagttccccaaggtgcagtggcc

SEQ ID NO: 307396 - DNA, 231 bp, Homo sapiens
gcagaagagaaataaaattccctacagtttctttaaaactgccctggacgacaggaaagaggtgagtctgggaagcaaataaagatctctccatcctccgtatttatgagagtgcaaggggttaaccctgtcatttctgaccttcttcgccagtttgcaccagggagtcagtgatcttcgttgggtcctaacaataatcaataaatgactattgattgagctctctatgcg

SEQ ID NO: 307397 - DNA, 603 bp, Homo sapiens
gatcaagaggaccccttcagtgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaaaaaggtgcggaatcagcacatttagtgggagtgggggggaggtcaggactatgatcggataagggatttaataccttagagcaaaatctatagagtctcgctcagtttatcagtttaaatggcttgaggctaatggggggtgt

SEQ ID NO: 307398 - DNA, 833 bp, Homo sapiens
  misc_feature (24)..(24): n is a, c, g, or t
aaacagtgtatcaacgcagagtgnccattacggccgggattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaccacacacacaccaacaccacacacaccaccacacccacccccccccccccccccctcccacacacccaccccccacccccaccaccactccccccccccccccccccacaaacaccttcccacacccacccccgagcgccggcggcccccaaccgcgaaacgccaccagcgcacacacggcacgccagcagaacaccaccctgcccacacacccccggcggggctagtcccccccacaaaaaaaagacccgcgggcgggcaacacaggggccgcacaacacaccacccgagggacgcccacgcgccaccccccgcgcacccaacacgagggccccaccaacggcgcctaataaaaccc

SEQ ID NO: 307399 - DNA, 879 bp, Homo sapiens
gttagcatctttggaaaaattcctaaacttatttgggaacaaattgttattatatgaggctaatggtacctagaaataactagaataattcccaagaagttatgcctttataaaatattcatctttggcaatgaccagaaatgtctacctttacataaattagtgtgtccactctttttggggctggtggggtgtcttctgactggccttcatgtgtgggaatagccccattccaagtgctgcttgattgtaaaattggaccaagcctgtcatcacactgcccagtctttgggtagggggagctgagagattctgtgaatattgtcagaagggacatgtttttggatagggagggaaaaaaagcaagatccccaggtcccctgattttaaccatgacgtagaaaactccacacagaccctcctcccttccgccctggcacagagtcccgttgtcctttcataggcggtgtcagaaaccctgtggtgaaattcagcctgtggattccagaaatttggagtgttcttggggggaaaaatccgcacacacaaagcaacatttggaaatccctgtggtgagttgggaggtggggaggggatgcagtatgggaaggctggaagggaaagcgccggtgtacatccctccctcttctttccagggctctgagtgtcagggctgagatgaagatgacaccctggcagaggaggaggcagggtgctgggggcagggcatggacattgaggtctgtgctgagctttacagtttgcaagcactttcatgttatcttgtgggggtagatcagtgactccatagccattttataggcatagacactgaatttcacagtggttaaataaatttcccaagaccacatggttgga

SEQ ID NO: 307400 - DNA, 694 bp, Homo sapiens
ttttgattctgctgtggtgataaagatactctgccttgcccattaagcatttgttggtggaaaacattacctttaaataaatgtctggttctatgtgagcaaagctagggctcccataaaattgggcaatgatactctgaattcagctgaactgtttgggcaactttgtcacttctggggccatcattttcaggatagttcccacagtgtgagaaaatgactgcttcctatagtactgtcaagagtgtgaaaagagagctctttagcaaacacattatttatccatccttaaaaagcttgtcacctccagggtgcttgttcagaagtaatctcattacttaaatcatatcctagcatgtggaaaagctccctgacttccccgcctgccccacctgctgatttctcaggaccgctgataacagctttcatgtggaacttgggattaatatcaagcaagccatggattttgtctccactgaacttgggcatcatggacagtttccattccagcagttaagggcttcctgactttcaacagtggtgctgatcccagttctgaagagtggaacatcagagagcctcccctcctcagccacttgtaagcataacaaactgaaaatgtaatctgctttcaaatattctgttgagtaaagattccttttaattactttaactgggtttttgtagagacaag

SEQ ID NO: 307401 - DNA, 496 bp, Homo sapiens
aggaaacaagtttcactaaagaagcctacaagaagtacatcaaagattacatgaaatcaatccaaggggtaggtattccaagaattcaagaatggacattagtaaagaataaaacatttatttgagcttggaattatttggatcatctatatggcctaaaaatatatggactatgcctgtgtacctgaatacgtatgtagtcaggtcaagacaatcatccaaataacttagacccctaaaagcaaggccaggatttgcaatttaatgtgtcccaattaattcacttgaaaattagtaacactctgtttacgttgcctctggctggagctgcatggtggaagaagcccaactttggatccatgtacttcacccatccaatactcttgggacatttatgtgtattttatctgtatatatgaagccaatgtctatgtctacacagtcaaagtgaaatgcatgtttgatatagctgtacatagatatctattttgcaggt

SEQ ID NO: 307402 - DNA, 563 bp, Homo sapiens
ctgtgaaagttccagaagaaagctgtatggtcagcttggggaaatatgtggttcatgctggaatgctggacataccacattattggaaagatgcacattgaatgaccgacaaaatgaaactcaactttccaaatgctggtaatgagagaagattctgttctaatgaccagttgtttcctgaaagaatgtcagctcgattcataatgaatgcattctaaccatgacagccacagtcaggacacaaaaaacaaagtgtccttgatcccaggaaacagccctctggaatctgtgaaatctagaaactagattgggaaaactctgacacccctgccccatgaccaaccaagactaagagtcccaggaagattgaggtcacagaaggcagaggcctgccccctctccaggagatccctgacccatgtggggtcatgggcggggcatgagtgatgtgatgggaaactggctcctggctccaagtagaacgtgaccaactggagcctgacaggaggtccctggcactggtcagcccatcaaaccaggtaagtccttggagtctgagtagg

SEQ ID NO: 307403 - DNA, 3021 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 307404 - DNA, 3130 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgcggtgtcagaaaccctgtggtgaaattcagcctgtggattccagaaatttggagtgttcttggggggaaaaatccgcacacacaaagcaacatttggaaatccctgtggactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 307405 - DNA, 3088 bp, Homo sapiens
  misc_feature (24)..(24): n is a, c, g, or t
  misc_feature (3057)..(3059): n is a, c, g, or t
  misc_feature (3071)..(3072): n is a, c, g, or t
  misc_feature (3078)..(3078): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaaaaaaaaaaaaaaaacaaacacaaaaaaacnnntggggggcgccnngggccncggaaaaacc

SEQ ID NO: 307406 - DNA, 3698 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaatatttgtcattgaatccattgccatcccatttgactgttcttttcatcctactgtctagtaataagctgagtataagatgacagtgtaatctccctgaaagcaggagctactttctttcttttgtaatctatttccatccccatttccctgtcctgtctccctgtattcactcccaagctcagttctgaatagacattcctgctcagagatactcccaactgatgcagaaaccaaataaagaggtaggtattccaagaattcaagaatggacattagtaaagaataaaacatttatttgagcttggaattatttggatcatctatatggcctaaaaatatatggactatgcctgtgtacctgaatacgtatgtagtcaggtcaagacaatcatccaaataacttagacccctaaaagcaaggccaggatttgcaatttaatgtgtcccaattaattcacttgaaaattagtaacactctgtttacgttgcctctggctggagctgcatggtggaagaagcccaactttggatccatgtacttcacccatccaatactcttgggacatttatgtgtattttatctgtatatatgaagccaatgtctatgtctacacagtcaaagtgaaatgcatgtttgatatagctgtacatagatatctattttgcaggt

SEQ ID NO: 307407 - DNA, 3648 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaatacatcctactgtctagtaataagctgagtataagatgacagtgtaatctccctgaaagcaggagctactttctttcttttgtaatctatttccatccccatttccctgtcctgtctccctgtattcactcccaagctcagttctgaatagacattcctgctcagagatactcccaactgatgcagaaaccaaataaagaggtaggtattccaagaattcaagaatggacattagtaaagaataaaacatttatttgagcttggaattatttggatcatctatatggcctaaaaatatatggactatgcctgtgtacctgaatacgtatgtagtcaggtcaagacaatcatccaaataacttagacccctaaaagcaaggccaggatttgcaatttaatgtgtcccaattaattcacttgaaaattagtaacactctgtttacgttgcctctggctggagctgcatggtggaagaagcccaactttggatccatgtacttcacccatccaatactcttgggacatttatgtgtattttatctgtatatatgaagccaatgtctatgtctacacagtcaaagtgaaatgcatgtttgatatagctgtacatagatatctattttgcaggt

SEQ ID NO: 307408 - DNA, 3127 bp, Homo sapiens
  misc_feature (24)..(24): n is a, c, g, or t
  misc_feature (3089)..(3089): n is a, c, g, or t
  misc_feature (3124)..(3124): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataaaaaaaaaaaaaaaaaaaaaaaaaaaaaaaaaaaaaaaaaaaataaaaaaaaaaaaaaaaaaaaaaanaaaaaaaaaaaaaaaaaaaaaaaaaaaaaaaaaanaag

SEQ ID NO: 307409 - DNA, 3158 bp, Homo sapiens
  misc_feature (24)..(24): n is a, c, g, or t
  misc_feature (3120)..(3120): n is a, c, g, or t
  misc_feature (3155)..(3155): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataaaaaaaaaaaaaaaaaaaaaaaaaaaaaaaaaaaaaaaaaaaataaaaaaaaaaaaaaaaaaaaaaaaaaaaaaaaaaaaaaaaaaaaaaaaaaaaaanaaaaaaaaaaaaaaaaaaaaaaaaaaaaaaaaaanaag

SEQ ID NO: 307410 - DNA, 3109 bp, Homo sapiens
  misc_feature (24)..(24): n is a, c, g, or t
  misc_feature (3071)..(3071): n is a, c, g, or t
  misc_feature (3106)..(3106): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaaaaaaaaaaaaaaaaaaaaaaaaaaaaaaaaaaaaaaaaaaaaanaaaaaaaaaaaaaaaaaaaaaaaaaaaaaaaaaanaag

SEQ ID NO: 307411 - DNA, 3124 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaaaaaggtgcggaatcagcacatttagtgggagtgggggggaggtcaggactatgatcggataagggatttaataccttagagcaaaatctatagagtctcgctcagtttatcagtttaaatggcttgaggctaatggggggtgt

SEQ ID NO: 307412 - DNA, 3366 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaagcggaatacagcacattaagtcaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcatcaacaaaatgtatgtctggttccccagtagagctatactgcctcaacccaaggggatattttaatgtctggggcagaaacactcaagttgattagaaagaccagccaatgtcagtgtatctgggtccttaacccacttggctagtgtgaattatagtacaatgatatttttttttgtggagataggtcagaacatagaggg

SEQ ID NO: 307413 - DNA, 3265 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgccatgtggaaaagctccctgacttccccgcctgccccacctgctgatttctcaggaccgctgataacagctttcatgtggaacttgggattaatatcaagcaagccatggattttgtctccactgaacttgggcatcatggacagtttccattccagcagttaagggcttcctgactttcaacagtggtgctgatcccagttctgaagagtggaacatcagagagcctcccctcctcagccacttgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 307414 - DNA, 3452 bp, Homo sapiens
gttagcatctttggaaaaattcctaaacttatttgggaacaaattgttattatatgaggctaatggtacctagaaataactagaataattcccaagaagttatgcctttataaaatattcatctttggcaatgaccagaaatgtctacctttacataaattagtgtgtccactctttttggggctggtggggtgtcttctgactggccttcatgtgtgggaatagccccattccaagtgctgcttgattgtaaaattggaccaagcctgtcatcacactgcccagtctttgggtagggggagctgagagattctgtgaatattgtcagaagggacatgtttttggatagggagggaaaaaaagcaagatccccaggtcccctgattttaaccatgacgtagaaaactccacacagaccctcctcccttccgccctggcacagagtcccgttgtcctttcataggcggtgtcagaaaccctgtggtgaaattcagcctgtggattccagaaatttggagtgttcttggggggaaaaatccgcacacacaaagcaacatttggaaatccctgtggactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 307415 - DNA, 3082 bp, Homo sapiens
atctcggaaccactgtgaaagtcaggaagccttaactgctggaatggaaactgtccatgatgcccaagttcagtggagacaaaatccatggcttgcttgatattaatcccaagttccacatgaaagctgttatcagcggtcctgagaaatcagcaggtggggcaggcggggaagtcagggagcctcccctcctcagccacttgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 307416 - DNA, 2959 bp, Homo sapiens
gcaccctctgaagcaacaggagctatagatgaaccttttaggggattctgtaatttttctgtccctttgatttccacaggactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 307417 - DNA, 3478 bp, Homo sapiens
ttttgattctgctgtggtgataaagatactctgccttgcccattaagcatttgttggtggaaaacattacctttaaataaatgtctggttctatgtgagcaaagctagggctcccataaaattgggcaatgatactctgaattcagctgaactgtttgggcaactttgtcacttctggggccatcattttcaggatagttcccacagtgtgagaaaatgactgcttcctatagtactgtcaagagtgtgaaaagagagctctttagcaaacacattatttatccatccttaaaaagcttgtcacctccagggtgcttgttcagaagtaatctcattacttaaatcatatcctagcatgtggaaaagctccctgacttccccgcctgccccacctgctgatttctcaggaccgctgataacagctttcatgtggaacttgggattaatatcaagcaagccatggattttgtctccactgaacttgggcatcatggacagtttccattccagcagttaagggcttcctgactttcaacagtggtgctgatcccagttctgaagagtggaacatcagagagcctcccctcctcagccacttgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 307418 - DNA, 3076 bp, Homo sapiens
  misc_feature (185)..(185): n is a, c, g, or t
  misc_feature (187)..(187): n is a, c, g, or t
  misc_feature (196)..(196): n is a, c, g, or t
ccctagagagcctcatggattgtaactaaagaagaaacggttcctttttgtttttttaaaaatgatttttaaataccgttttttacaccgttctctcggtactttttttaagctaagtcagcattgtcttccagtgttaaaggcatccctcacctctgcaaggaacccacgcgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 307419 - DNA, 3070 bp, Homo sapiens
  misc_feature (179)..(179): n is a, c, g, or t
  misc_feature (181)..(181): n is a, c, g, or t
  misc_feature (190)..(190): n is a, c, g, or t
gagctgttgggaggcacagagtcccaacacagctggtaaagcacttagcccaggacccggccctagcaaggcaattagagggtgtctgtctttattttaagtcgccctccagctaatgggaaacacaagggcaggatcccacctggacgtcttctctgcaaggaacgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 307420 - DNA, 3419 bp, Homo sapiens
ctgtgaaagttccagaagaaagctgtatggtcagcttggggaaatatgtggttcatgctggaatgctggacataccacattattggaaagatgcacattgaatgaccgacaaaatgaaactcaactttccaaatgctggtaatgagagaagattctgttctaatgaccagttgtttcctgaaagaatgtcagctcgattcataatgaatgcattctaaccatgacagccacagtcaggacacaaaaaacaaagtgtccttgatcccaggaaacagccctctggaatctgtgaaatctagaaactagattgggaaaactctgacacccctgccccatgaccaaccaagactaagagtcccaggaagattgaggtcacagaaggcagaggcctgccccctctccaggagatccctgacccatgtggggtcatgggcggggcatgagtgatgtgatgggaaactggctcctggctccaagtagaacgtgaccaactggagcctgacaggaggtccctggcactggtcagcccatcaaaccaggactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 307421 - DNA, 3108 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtgcaagtaatacaactttggaagatttatgagtacaattggattggtttttttcccttgtgtctttgctgtttttcttggcctctcagcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 307422 - DNA, 2482 bp, Homo sapiens
caacggagatcaggcattaaagagaattcaagagttccccagactctggaaaatgtagttgttgataacagactagcattggattatttactagctggacaaggtggggtcttgtgcagttattaataaaacctgctgcacatatattaacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 307423 - DNA, 2844 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 307424 - DNA, 2257 bp, Homo sapiens
ttccagagctctggattgttgttaaatatgatgcctttggacaaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 307425 - DNA, 2541 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttt

SEQ ID NO: 307426 - DNA, 3645 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctatcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaatatttgtcattgaatccattgccatcccatttgactgttcttttcatcctactgtctagtaataagctgagtataagatgacagtgtaatctccctgaaagcaggagctactttctttcttttgtaatctatttccatccccatttccctgtcctgtctccctgtattcactcccaagctcagttctgaatagacattcctgctcagagatactcccaactgatgcagaaaccaaataaagaggtaggtattccaagaattcaagaatggacattagtaaagaataaaacatttatttgagcttggaattatttggatcatctatatggcctaaaaatatatggactatgcctgtgtacctgaatacgtatgtagtcaggtcaagacaatcatccaaataacttagacccctaaaagcaaggccaggatttgcaatttaatgtgtcccaattaattcacttgaaaattagtaacactctgtttacgttgcctctggctggagctgcatggtggaagaagcccaactttggatccatgtacttcacccatccaatactcttgggacatttatgtgtattttatctgtatatatgaagccaatgtctatgtctacacagtcaaagtgaaatgcatgtttgatatagctgtacatagatatctattttgcaggt

SEQ ID NO: 307427 - DNA, 3646 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaatatttgtcattgaatccattgccatcccatttgactgttcttttcatcctactgtctagtaataagctgagtataagatgacagtgtaatctccctgaaagcaggagctactttctttcttttgtaatctatttccatccccatttccctgtcctgtctccctgtattcactcccaagctcagttctgaatagacattcctgctcagagatactcccaactgatgcagaaaccaaataaagaggtaggtattccaagaattcaagaatggacattagtaaagaataaaacatttatttgagcttggaattatttggatcatctatatggcctaaaaatatatggactatgcctgtgtacctgaatacgtatgtagtcaggtcaagacaatcatccaaataacttagacccctaaaagcaaggccaggatttgcaatttaatgtgtcccaattaattcacttgaaaattagtaacactctgtttacgttgcctctggctggagctgcatggtggaagaagcccaactttggatccatgtacttcacccatccaatactcttgggacatttatgtgtattttatctgtatatatgaagccaatgtctatgtctacacagtcaaagtgaaatgcatgtttgatatagctgtacatagatatctattttgcaggt

SEQ ID NO: 307428 - DNA, 2888 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccattttaaaaaaaaaaaaaaaaaaaaaaaaaaaaaaaaaaaaaaaaaaatttttgggcggccgggccccaaaaatttttaaacccatctccgttggggcgcgggcgcccaagtggggtacgtgcaacactggggcacaaaggcgggtcccctaagaggagaactccgcggccaaaagagactaaggcggtggggtttcctcccaatataaaaaacaacggccggggggggacacccggaggcgtgttcgtgagaaacaacctcacaaaatggaggggcacaagagcgacccacgcggggagtcttattcagacggggcgccaaacggagagcgccgaatatataaattatcgg

SEQ ID NO: 307429 - DNA, 1844 bp, Homo sapiens
gcttaaggatgatgaaagccatcctcgttacacgttctgagacgatcccacgtgaagacattgcaaggacagtgtgttgagagcatacagaagatacacgacttgtccttgcaatgtcttcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 307430 - DNA, 1949 bp, Homo sapiens
atatggtgtcacacaaaaataatctttgccttagtgacttataaaacaatagtaaatctgtggctattccacagagctacctgattatactaacacttgctgtaataagatttggtttgcattgctttaccccagcacatgaaaggcaaaactggggactctctgaggttgggtcagaacacagggggtgaatgaaataggacatagaaagggcttgagttccagttgttcatctgaggggatggagggcattgtagctgataaccccaaaacagtgttctgactgacccatgttttcagaatgaatcaaacagagactgagtgactctagcctttaatattctggctaactgtctgatcattttcataggttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 307431 - DNA, 2360 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatctacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 307432 - DNA, 1098 bp, Homo sapiens
  misc_feature (58)..(58): n is a, c, g, or t
ttgataatccaggccctgggaggcttctttacttactcgctacaccgtgtgtacgagntaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 307433 - DNA, 1039 bp, Homo sapiens
aggaccccaattaggctggcgcacagtatgtacgctacccgatgatagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 307434 - DNA, 1488 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgtaagagcccttccttaaaactgagtgtgccactcttgaaaatgtc

SEQ ID NO: 307435 - DNA, 1306 bp, Homo sapiens
  misc_feature (24)..(24): n is a, c, g, or t
  misc_feature (1275)..(1277): n is a, c, g, or t
  misc_feature (1289)..(1290): n is a, c, g, or t
  misc_feature (1296)..(1296): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtaagaatttatcaaataaataatacatcttaaaaacaaggtaaaaaaaaaaaaaaaaacaaacacaaaaaaacnnntggggggcgccnngggccncggaaaaacc

SEQ ID NO: 307436 - DNA, 639 bp, Homo sapiens
gtatccagaggatcccttcagcacatttagtcaagtacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 307437 - DNA, 2168 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacggtactgaaattttcactctcacatcttgaccatctgtcctttactgaacaaggagctaggagggataacagaccaaaggaatcacatgccattttctacattgctcttgtttaaacatttctaagtactcctcgtttttttccctagtgtttctgctttgttcacttataaaatataaatttccataaagtaggggccagcatctactagccttttgtatctttcctcattactctaggaaatagaattctacccacagttgaaacttaacaaatgtgattagttcgtttggttattaacatatcctaccaccaatcaactttatatatttaaccatttccagttgttcttttgggcatgatatatacatacatatatacatacatacccacacatatatacacacactcctccctcaaagctactaaacatgaaaacattgtgcctatatgataaaaatgtcaatattgctggtgatactgatgctgatggaaatgacgatattagctgccattaacgtagtatctaatgtgtgccaaacaatattaaaaattgctgtatatacatgtttgccatttattatttataaccttaacaagatgtctcactcataagactactttccgcactatgatacagaaatgaatattaaaacatgtgcatgctcatgtcaaactcatagaacttgattttattttggcaggattaaaccaatttgcaacttgagtacaaatgccaatatttcagctagttcttgaaaagttgtgccattgtgcaaaagtcattgaattatttgataactttttaacctaatgaccaaacacctgacaggaatggaattcactggacttgtatctaattgttttacactgttttctatgggttacattttttattgccattgtgacctttatccacacactaacctggaaagtataggaataaaagaattggcattctttctgatacaccctttttgttttcttcttaaagtcatttatattatgtattactcttaaagaatgttttagtctccattttagtagtctgtgcataaggtagtaatacatgtacacaaagaaaaattcacaagcccattcaggtgtcttttagaacattatttaccactaaatatttatacagttgacataatgcttattatgcccttgaataatagaatttgttttgtttttacttcttatccataagcattggccttacattgcctcaagaggaacagaatttattattaaacaggattcttaaatccataactcatattgtgacttcatacattttgtaaccctagtagtgaatataccctaaaaacctataaatccccccaaatcactctactgatg

SEQ ID NO: 307438 - DNA, 500 bp, Homo sapiens
gatcaagaggaccccttcagtgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 307439 - DNA, 1282 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacggtactgaaattttcactctcacatcttgaccatctgtcctttactgaacaaggagctaggagggataacagaccaaaggaatcacatgccattttctacattgctcttgtttaaacatttctaagtactcctcgtttttttccctagtgtttctgctttgttcacttataaaatataaatttccataaagtaggggccagcatctactagccttttgtatctttcctcattactctaggaaatagaattctacccacagttgaaacttaacaaatgtgattagttcgtttggttattaacatatcctaccaccaatcaactttatatatttaaccatttccagttgttcttttgggcatgatatatacatacatatatacatacatacccacacatatatacacaccccaaaacacatacattgaaagtgcctcatctgaataaaatgacttgtgtcttccctttgggatctgct

SEQ ID NO: 307440 - DNA, 1129 bp, Homo sapiens
  misc_feature (24)..(24): n is a, c, g, or t
  misc_feature (1098)..(1100): n is a, c, g, or t
  misc_feature (1112)..(1113): n is a, c, g, or t
  misc_feature (1119)..(1119): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtaagaatttatcaaataaataatacatcttaaaaacaaggtaaaaaaaaaaaaaaaaacaaacacaaaaaaacnnntggggggcgccnngggccncggaaaaacc

SEQ ID NO: 307441 - DNA, 1100 bp, Homo sapiens
tggtttcttcaccggactatttctccctcaaactctgggcctctgctttttctctggtagccgggttctcgggtgtgaacaggagcagatgaccaatagcacctagctgggtgacaatcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaatatttgtcattgaatccattgccatcccatttgactgttcttttcatcctactgtctagtaataagctgagtataagatgacagtgtaatctccctgaaagcaggagctactttctttcttttgtaatctatttccatccccatttccctgtcctgtctccctgtattcactcccaagctcagttctgaatagacattcctgctcagagatactcccaactgatgcagaaaccaaataaagaggtaggtattccaagaattcaagaatggacattagtaaagaataaaacatttatttgagcttggaattatttggatcatctatatggcctaaaaatatatggactatgcctgtgtacctgaatacgtatgtagtcaggtcaagacaatcatccaaataacttagacccctaaaagcaaggccaggatttgcaatttaatgtgtcccaattaattcacttgaaaattagtaacactctgtttacgttgcctctggctggagctgcatggtggaagaagcccaactttggatccatgtacttcacccatccaatactcttgggacatttatgtgtattttatctgtatatatgaagccaatgtctatgtctacacagtcaaagtgaaatgcatgtttgatatagctgtacatagatatctattttgcaggt

SEQ ID NO: 307442 - DNA, 497 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtgagtctgttcataatcgaag

SEQ ID NO: 307443 - DNA, 1081 bp, Homo sapiens
ctttcccgagtagctaggaccacaggagtgcaccaccacgccctgctaatttttttctatttctggtagagacagggttttggcatgtttcccaggctggacttgaactcctgtgctcaggcaatcccactgcctcagccttcccaaatgctgggattacagatgtgagccactagacctgtcctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaatatttgtcattgaatccattgccatcccatttgactgttcttttcatcctactgtctagtaataagctgagtataagatgacagtgtaatctccctgaaagcaggagctactttctttcttttgtaatctatttccatccccatttccctgtcctgtctccctgtattcactcccaagctcagttctgaatagacattcctgctcagagatactcccaactgatgcagaaaccaaataaagaggtaggtattccaagaattcaagaatggacattagtaaagaataaaacatttatttgagcttggaattatttggatcatctatatggcctaaaaatatatggactatgcctgtgtacctgaatacgtatgtagtcaggtcaagacaatcatccaaataacttagacccctaaaagcaaggccaggatttgcaatttaatgtgtcccaattaattcacttgaaaattagtaacactctgtttacgttgcctctggctggagctgcatggtggaagaagcccaactttggatccatgtacttcacccatccaatactcttgggacatttatgtgtattttatctgtatatatgaagccaatgtctatgtctacacagtcaaagtgaaatgcatgtttgatatagctgtacatagatatctattttgcaggt

SEQ ID NO: 307444 - DNA, 599 bp, Homo sapiens
  misc_feature (24)..(24): n is a, c, g, or t
  misc_feature (522)..(522): n is a, c, g, or t
  misc_feature (540)..(540): n is a, c, g, or t
  misc_feature (589)..(589): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggaccccccatctcacgccacaacaaaattattttgagatagtaatagacccagaagtaaaggctaaaaatataaatctaaaaggaaacaatattttcatgaccttggggtaggcaaagatttattaaagaggacacaaaaaacaacaaacagaaggaaaaacctgaaaattgcntcattataagtgtctggntcctcaaaaggacaccttttaggaaaatggaattggttaggccacagangggaggaggt

SEQ ID NO: 307445 - DNA, 512 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgtatgtatctcttaatctgactgagccctcaacctgtgggatcagacactctttccaggtagatagtgttggaactgagttggaggacacccagctggtgcccgctgcttggtgtgtgggggaaaatcccctacatttggtcgcagaagtcttctgtgttgatgactgttgtcgtggtgtgagagcagagggaaaacactgcttgagtgtttttctgaaataggagggcctaagaactatactgttctatgccacagaactggccccctactttccttgaaaggctggctatccaatggtgaggagaggaagtggtagcctgaaccagcctccccatttccccacctcccaccccagttcagagcccagat

SEQ ID NO: 307446 - DNA, 180 bp, Homo sapiens
aaatacatggcaaataaatctgtttcgctagatgtctaaactgagtaaaaatagacaatattttgactttttttccagcaaggatttgaaagatgccatagaagttctgatagcagaaaaaagacgcaggatttccacagaagagaaactggaagaatgtatggactttgccactgagtt

SEQ ID NO: 307447 - DNA, 3951 bp, Homo sapiens
ctgggtcctgtgtgtgccacaggggtggggtgtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctagcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacaggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgcctt

SEQ ID NO: 307448 - DNA, 3354 bp, Homo sapiens
ctgggtcctgtgtgtgccacaggggtggggtgtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctagcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacaggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggtacgtatagaatataatttcctttgtgatgtacatcttaatggtcagaatttaaaggcaaaatttcatgccattgtactgaaaatacattaaggttttgtgttatcctctaggagatgtttttgattcagcctctgatcccgtgccattaccacctgccaggcctccaactcgggacaatccaaagcatggttcttcactcaacaggacgccctctgattatgatcttctcatccctccattaggttgaaacctttaaaaaagttttgaacaacccacccctccttcttttaatttcagaattttcagaattcagagttcagtataacacagactcactgggttgtgaatttgcctgaaatttgaatgggttctccaggtgccggtgactcccaagttcacgagaccattactccatgtagatgattaaggtagtagtgtagtagttgggcatcagtcaggttttaagcaagttgttttgtccatactaaatgtagtctaaaaacacatgagagctttgtgctctagtagttttgaagtgatgacttgaagtgttgagattttctttaagtataataattcttaataaatatgaacttgcttttcttgcagcatgagcaccagttccacttacgctaattaaattatgcaaaattaaatagttgtatgtagagaactgataataaattctgttttattctaatcattacaactgtaacacattcaaaaaaaaaaa

SEQ ID NO: 307449 - DNA, 3241 bp, Homo sapiens
ctgggtcctgtgtgtgccacaggggtggggtgtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctagcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacaggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggttgaaacctttaaaaaagttttgaacaacccacccctccttcttttaatttcagaattttcagaattcagagttcagtataacacagactcactgggttgtgaatttgcctgaaatttgaatgggttctccaggtgccggtgactcccaagttcacgagaccattactccatgtagatgattaaggtagtagtgtagtagttgggcatcagtcaggttttaagcaagttgttttgtccatactaaatgtagtctaaaaacacatgagagctttgtgctctagtagttttgaagtgatgacttgaagtgttgagattttctttaagtataataattcttaataaatatgaacttgcttttcttgcagcatgagcaccagttccacttacgctaattaaattatgcaaaattaaatagttgtatgtagagaactgataataaattctgttttattctaatcattacaactgtaacacattcaaaaaaaaaaa

SEQ ID NO: 307450 - DNA, 4108 bp, Homo sapiens
ctgggtcctgtgtgtgccacaggggtggggtgtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctagcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacaggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagag

SEQ ID NO: 307451 - DNA, 3876 bp, Homo sapiens
cttaatgctactgcgcgtaccgcttactatctgaatcgggcgcgaggtaagagcgtatgtgcatttgtcttgacctaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctagcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacaggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagag

SEQ ID NO: 307452 - DNA, 3976 bp, Homo sapiens
ctgggtcctgtgtgtgccacaggggtggggtgtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctagcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacaggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagag

SEQ ID NO: 307453 - DNA, 1936 bp, Homo sapiens
aaggcacaaggttaaggaaggttggggccttccttggaccccaaggttggcctttaattggccggaaaaccaaccagacgccatgatttgcctttagaaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagag

SEQ ID NO: 307454 - DNA, 1608 bp, Homo sapiens
aacccatggttttatgtatatttgtttgtttgttttttgcttttactttagaacagtttctatacattgtacaggttggattgggacagaaaataaaatttagaagctgtttttattgtcaacaatcttataattaaatatatctgcaaaatataaatataaaacaagtagtctttattatctggaaataaatgtgaagagcatatttaagcaagtgatgaataaattagaaaatatgcaggcagtaaaaaatggttaatatcagtcatgaatttaattttctaatttatttttgaaagccataatcttcataaaataattctagaatttttttcttcagccaatcaacagagatcatccttttaatttgaaacttgtttttatttttaagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagag

SEQ ID NO: 307455 - DNA, 978 bp, Homo sapiens
ttcttcaaaggcataaccctctcccatgagttttgcaatttttgcatcgacattttccaatgccgcctcaggcccatggggttttctgtggtgaatttctggtgcagtcctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagag

SEQ ID NO: 307456 - DNA, 602 bp, Homo sapiens
  misc_feature (36)..(36): n is a, c, g, or t
tagaggatcccccaagaacaaactgcaactttgccnaactgtaaacaaggtaaagcatttcacaggttcaaagttcaagggaagtaaacgtctttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagag

SEQ ID NO: 307457 - DNA, 937 bp, Homo sapiens
cttaatgctactgcgcgtaccgcttactatctgaatcgggcgcgaggtaagagcgtatgtgcatttgtcttgacctaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaagcctccaggcctgtgatgagagaagctgccgtgaagacctctgacatgccctggagacattttcctcattgtcttggtgattaacatttggctcctccttacttatacaaatttctgcagccagcttgaggttcttctcagagaatgtgtttttcttttttatcacattgtcaggctgcaaattttctgaactttaatgctccgcttcttcttgaaacataagttccaattccatatcatatctttgtgaatgaataaaacttaatgcttttaacagtacc

SEQ ID NO: 307458 - DNA, 881 bp, Homo sapiens
cttaatgctactgcgcgtaccgcttactatctgaatcgggcgcgaggtaagagcgtatgtgcatttgtcttgacctaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaacattttcctcattgtcttggtgattaacatttggctcctccttacttatacaaatttctgcagccagcttgaggttcttctcagagaatgtgtttttcttttttatcacattgtcaggctgcaaattttctgaactttaatgctccgcttcttcttgaaacataagttccaattccatatcatatctttgtgaatgaataaaacttaatgcttttaacagtacc

SEQ ID NO: 307459 - DNA, 259 bp, Homo sapiens
ctggtccgttagcaaattctctttcagagaaaacaagagacccagtagaggaagatgatgatgaatacaagattccttcatcccaccctgtttccctgaattcacaaccatctcattgtcataatgtaaaacctcctgttcggtaagagtatgggcagatttttgccacttacatctgcataagcattatcatttgtaatgtttgtttttaaacaattgattcacgtctaattaaaaatccttaatttccagctcaaat

SEQ ID NO: 307460 - DNA, 400 bp, Homo sapiens
tcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaagaaggtaagaaatacgcaaagcagaagctagagaatctgcttataaatgcttctgatggtcagtagcataaaaggttgggaagtgtttttttttgcctagcatggcacttccctgtaagtctttaattatccccaagttataaataatcagaagctcattaaaacttgaacttaagagaagtcaggaggttctaagtaatgatttaattttaatgtgaagacactagacaatttgccagagatttat

SEQ ID NO: 307461 - DNA, 457 bp, Homo sapiens
ggtcaacttcagcgctggcctgggcttggctcttgaacccttcccttgaacttcaccaacaccctcagccccgcctcggcccacagccctcactcagcctccccaacctgaatctccagaattcgattttttaaccatgaaccagaagatgctgaagccacacagaacacctccggccccggtgactgaagagatgctacagcggtgcaagtacagccacatggagccccctctgggtggactgcgcttcttctcaacacaatacaaggacgagtttcctttcaagtaccagggcccagcagccctgagactgaaaaatcctcaggagggcttcgtgcccctgggcacgcctcaccagcgcggctgcagggagaagatagaccctctggtcccccagccccctatgtacctgtgccccagccagcaataaatgccatcttggcaacattccaaactt

SEQ ID NO: 307462 - DNA, 406 bp, Homo sapiens
gagccaaagctactcaaacgcttcttcaagaccaccatgggctcggactactgcccttcagagtggagaattcgattttttaaccatgaaccagaagatgctgaagccacacagaacacctccggccccggtgactgaagagatgctacagcggtgcaagtacagccacatggagccccctctgggtggactgcgcttcttctcaacacaatacaaggacgagtttcctttcaagtaccagggcccagcagccctgagactgaaaaatcctcaggagggcttcgtgcccctgggcacgcctcaccagcgcggctgcagggagaagatagaccctctggtcccccagccccctatgtacctgtgccccagccagcaataaatgccatcttggcaacattccaaactt

SEQ ID NO: 307463 - DNA, 1952 bp, Homo sapiens
cgggagcgcctggcggggccgctgggccgagggggccgccggcggggctggcgggcggggggcttcctgcgggcccggggggagccggcggccggcgcgggcgcggcgggccgggcaggggcgaggggcgccgggtcttgccccagaagctgcgggcacatccacgcctgaaatgcggcgctcagtcctggtcaggaacccaggccacaaaggcctgagacccgtttatgaagagctcgactctgactccgaggacctagaccccaatcctgaagatctggacccggtttctgaagacccagagcctgatcctgaagacctcaacactgtcccggaagacgtggaccccagctatgaagatctggagcccgtctcggaggatctggaccccgacgccgaagctccgggctcggaaccccaagatcccgaccccatgtcttcgagtttcgacctcgatccagatgtgattggccccgtacccctgattctcgatcctaacagcgacaccctcagccccggcgatccaaaagtggaccccatctcctctggcctcactgccaccccccaggtcttggccaccagccccgcggtgctccccgcccccgccagcccgccccggcccttctcctgcccggattgcgggcgagccttccgccgcagctccgggctgagccagcatcgccgcacgcacagcggcgagaagccgtaccgctgccccgactgcgggaagtccttcagccacggtgccaccctggctcagcaccgtggcatccacactggggcgcggccgtaccagtgcgcggcctgcggcaaggccttcggctggcgctccacgctgctgaaacatcgcagcagccacagcggggagaagccgcaccactgcccggtgtgtggcaaggccttcgggcacggctcgctcctggcacagcacctgcgcacgcacggcggcccgcggccccacaagtgcccggtgtgcgccaagggcttcggccagggctctgcgctgctcaaacacctgcgcacgcacacgggcgagcggccctacccgtgtccgcagtgcggcaaggccttcgggcagagctcggcgctgctgcagcaccagcgcacacacacggccgagcgcccctaccgctgcccccactgcggcaaagccttcgggcagagctccaacttgcaacaccacctgcgcatccacacgggcgagcggccctacgcctgcccgcactgctccaaggccttcggccagagctcagcgctgctccagcacctgcacgtgcattcgggcgagcgtccctatcgctgtcagctctgcgggaaggccttcggccaggcctccagcctcaccaagcacaaacgggtgcatgagggtgcagccgctgctgcagctgccgcggccgctgcagctgcagcagcggccgccggcctgggcctcgggcctggcctaagccctgcatccatgatgaggccggggcaggtctccctcctgggtcctgatgctgtttctgtgctcggctctggcttgggcctcagccctggcaccagctctggccgcaaccctgaccctggctctgggccgggcactctgccggatcccagctccaaacccctccccggctccagatccacccccagccctactcctgtggaatcttctgacccaaaggctgggcacgacgctggtcccgaccttgtgcccagcccagaccttgatcctgtgcccagcccagaccctgatcctgtgcccagccctgatcccaaccctgtgtcctgccctgacccctgttctcccactcgtggcactgtcagcccagccctccctaccggcgagagtccagagtgggtacaggagcaaggggcactgctggggcctgatggctgaaggagacgccggcatcctcgggggcctggggaagttgtgtgttgtgcagtcagtaaaatcctcccactgccgg

SEQ ID NO: 307464 - DNA, 1676 bp, Homo sapiens
  misc_feature (29)..(29): n is a, c, g, or t
acaacgaaattagggctggtacgaggctnggggtgctgaagacctcaacactgtcccggaagacgtggaccccagctatgaagatctggagcccgtctcggaggatctggaccccgacgccgaagctccgggctcggaaccccaagatcccgaccccatgtcttcgagtttcgacctcgatccagatgtgattggccccgtacccctgattctcgatcctaacagcgacaccctcagccccggcgatccaaaagtggaccccatctcctctggcctcactgccaccccccaggtcttggccaccagccccgcggtgctccccgcccccgccagcccgccccggcccttctcctgcccggattgcgggcgagccttccgccgcagctccgggctgagccagcatcgccgcacgcacagcggcgagaagccgtaccgctgccccgactgcgggaagtccttcagccacggtgccaccctggctcagcaccgtggcatccacactggggcgcggccgtaccagtgcgcggcctgcggcaaggccttcggctggcgctccacgctgctgaaacatcgcagcagccacagcggggagaagccgcaccactgcccggtgtgtggcaaggccttcgggcacggctcgctcctggcacagcacctgcgcacgcacggcggcccgcggccccacaagtgcccggtgtgcgccaagggcttcggccagggctctgcgctgctcaaacacctgcgcacgcacacgggcgagcggccctacccgtgtccgcagtgcggcaaggccttcgggcagagctcggcgctgctgcagcaccagcgcacacacacggccgagcgcccctaccgctgcccccactgcggcaaagccttcgggcagagctccaacttgcaacaccacctgcgcatccacacgggcgagcggccctacgcctgcccgcactgctccaaggccttcggccagagctcagcgctgctccagcacctgcacgtgcattcgggcgagcgtccctatcgctgtcagctctgcgggaaggccttcggccaggcctccagcctcaccaagcacaaacgggtgcatgagggtgcagccgctgctgcagctgccgcggccgctgcagctgcagcagcggccgccggcctgggcctcgggcctggcctaagccctgcatccatgatgaggccggggcaggtctccctcctgggtcctgatgctgtttctgtgctcggctctggcttgggcctcagccctggcaccagctctggccgcaaccctgaccctggctctgggccgggcactctgccggatcccagctccaaacccctccccggctccagatccacccccagccctactcctgtggaatcttctgacccaaaggctgggcacgacgctggtcccgaccttgtgcccagcccagaccttgatcctgtgcccagcccagaccctgatcctgtgcccagccctgatcccaaccctgtgtcctgccctgacccctgttctcccactcgtggcactgtcagcccagccctccctaccggcgagagtccagagtgggtacaggagcaaggggcactgctggggcctgatggctgaaggagacgccggcatcctcgggggcctggggaagttgtgtgttgtgcagtcagtaaaatcctcccactgccgg

SEQ ID NO: 307465 - DNA, 2183 bp, Homo sapiens
cgggagcgcctggcggggccgctgggccgagggggccgccggcggggctggcgggcggggggcttcctgcgggcccggggggagccggcggccggcgcgggcgcggcgggccgggcaggggcgaggggcgccgggtcttgccccagaagctgcgggcacatccacgcctgaaatgcggcgctcagtcctggtcaggaacccaggccacaaaggcctgagacccgtttatgaagagctcgactctgactccgaggacctagaccccaatcctgaagatctggacccggtttctgaagacccagagcctgatcctgaagacctcaacactgtcccggaagacgtggaccccagctatgaagatctggagcccgtctcggaggatctggaccccgacgccgaagctccgggctcggaaccccaagatcccgaccccatgtcttcgagtttcgacctcgatccagatgtgattggccccgtacccctgattctcgatcctaacagcgacaccctcagccccggcgatccaaaagtggaccccatctcctctggcctcactgccaccccccaggtcttggccaccagccccgcggtgctccccgcccccgccagcccgccccggcccttctcctgcccggattgcgggcgagccttccgccgcagctccgggctgagccagcatcgccgcacgcacagcggcgagaagccgtaccgctgccccgactgcgggaagtccttcagccacggtgccaccctggctcagcaccgtggcatccacactggggcgcggccgtaccagtgcgcggcctgcggcaaggccttcggctggcgctccacgctgctgaaacatcgcagcagccacagcggggagaagccgcaccactgcccggtgtgtggcaaggccttcgggcacggctcgctcctggcacagcacctgcgcacgcacggcggcccgcggccccacaagtgcccggtgtgcgccaagggcttcggccagggctctgcgctgctcaaacacctgcgcacgcacacgggcgagcggccctacccgtgtccgcagtgcggcaaggccttcgggcagagctcggcgctgctgcagcaccagcgcacacacacggccgagcgcccctaccgctgcccccactgcggcaaagccttcgggcagagctccaacttgcaacaccacctgcgcatccacacgggcgagcggccctacgcctgcccgcactgctccaaggccttcggccagagctcagcgctgctccagcacctgcacgtgcattcgggcgagcgtccctatcgctgtcagctctgcgggaaggccttcggccaggcctccagcctcaccaagcacaaacgggtgcatgagggtgcagccgctgctgcagctgccgcggccgctgcagctgcagcagcggccgccggcctgggcctcgggcctggcctaagccctgcatccatgatgaggccggggcaggtctccctcctgggtcctgatgctgtttctgtgctcggctctggcttgggcctcagccctggcaccagctctggccgcaaccctgaccctggctctgggccgggcactctgccggatcccagctccaaacccctccccggctccagatccacccccagccctactcctgtggaatcttctgacccaaaggctgggcacgacgctggtcccgaccttgtgcccagcccagaccttgatcctgtgcccagcccagaccctgatcctgtgcccagccctgatcccaaccctgtgtcctgccctgacccctgttctcccactcgtggcactgtcagcccagccctccctaccggcgagagtccagagtgggtacaggagcaaggggcactgctggggcctgatggctgaaggagacgccggcatcctcgggggcctggggaagttgtgtgttgtgcagtcagtaaaatcctcccactgccggaaaaaaaccacacatcaaaaaactcgaagccaccaatacacaccactcacaacacacgaagaaaatcaaacagtgaccagtggtcacaatacagtggtaaccagtgaccccagacaacactggaaacacaaacgtagaacacatcaatgcagaaatacccataaatcaagatacccagaaaacaatctacctataacgcacagtacaccactacatatatcaccgtgacac

SEQ ID NO: 307466 - DNA, 1928 bp, Homo sapiens
cgggagcgcctggcggggccgctgggccgagggggccgccggcggggctggcgggcggggggcttcctgcgggcccggggggagccggcggccggcgcgggcgcggcgggccgggcaggggcgaggggcgccgggtcttgccccagaagctgcgggcacatccacgcctgaaatgcggcgctcagtcctggtcaggaacccaggccacaaaggcctgagacccgtttatgaagagctcgactctgactccgaggacctagaccccaatcctgaagatctggacccggtttctgaagacccagagcctgatcctgaagacctcaacactgtcccggaagacgtggaccccagctatgaagatctggagcccgtctcggaggatctggaccccgacgccgaagctccgggctcggaaccccaagatcccgaccccatgtcttcgagtttcgacctcgatccagatgtgattggccccgtacccctgattctcgatcctaacagcgacaccctcagccccggcgatccaaaagtggaccccatctcctctggcctcactgccaccccccaggtcttggccaccagccccgcggtgctccccgcccccgccagcccgccccggcccttctcctgcccggattgcgggcgagccttccgccgcagctccgggctgagccagcatcgccgcacgcacagcggcgagaagccgtaccgctgccccgactgcgggaagtccttcagccacggtgccaccctggctcagcaccgtggcatccacactggggcgcggccgtaccagtgcgcggcctgcggcaaggccttcggctggcgctccacgctgctgaaacatcgcagcagccacagcggggagaagccgcaccactgcccggtgtgtggcaaggccttcgggcacggctcgctcctggcacagcacctgcgcacgcacggcggcccgcggccccacaagtgcccggtgtgcgccaagggcttcggccagggctctgcgctgctcaaacacctgcgcacgcacacgggcgagcggccctacccgtgtccgcagtgcggcaaggccttcgggcagagctcggcgctgctgcagcaccagcgcacacacacggccgagcgcccctaccgctgcccccactgcggcaaagccttcgggcagagctccaacttgcaacaccacctgcgcatccacacgggcgagcggccctacgcctgcccgcactgctccaaggccttcggccagagctcagcgctgctccagcacctgcacgtgcattcgggcgagcgtccctatcgctgtcagctctgcgggaaggccttcggccaggcctccagcctcaccaagcacaaacgggtgcatgagggtgcagccgctgctgcagctgccgcggccgctgcagctgcagcagcggccgccggcctgggcctcgggcctggcctaagccctgcatccatgatgaggccggggcaggtctccctcctgggtcctgatgctgtttctgtgctcggctctggcttgggcctcagccctggcaccagctctggccgcaaccctgaccctggctctgggccgggcactctgccggatcccagctccaaacccctccccggctccagatccacccccagccctactcctgtggaatcttctgacccaaaggctgggcacgacgctggtcccgaccttgtgcccagcccagaccctgatcctgtgcccagccctgatcccaaccctgtgtcctgccctgacccctgttctcccactcgtggcactgtcagcccagccctccctaccggcgagagtccagagtgggtacaggagcaaggggcactgctggggcctgatggctgaaggagacgccggcatcctcgggggcctggggaagttgtgtgttgtgcagtcagtaaaatcctcccactgccgg

SEQ ID NO: 307467 - DNA, 991 bp, Homo sapiens
  misc_feature (17)..(17): n is a, c, g, or t
  misc_feature (57)..(57): n is a, c, g, or t
  misc_feature (93)..(93): n is a, c, g, or t
gctgctcaaacacctgncacgcacacggcgaaaggggccccgagggggccccccccntaaaacaccgggttgttacccaccgggacaccaaangggtgcggcaaggccttcgggcagagctcggcgctgctgcagcaccagcgcacacacacggccgagcgcccctaccgctgcccccactgcggcaaagccttcgggcagagctccaacttgcaacaccacctgcgcatccacacgggcgagcggccctacgcctgcccgcactgctccaaggccttcggccagagctcagcgctgctccagcacctgcacgtgcattcgggcgagcgtccctatcgctgtcagctctgcgggaaggccttcggccaggcctccagcctcaccaagcacaaacgggtgcatgagggtgcagccgctgctgcagctgccgcggccgctgcagctgcagcagcggccgccggcctgggcctcgggcctggcctaagccctgcatccatgatgaggccggggcaggtctccctcctgggtcctgatgctgtttctgtgctcggctctggcttgggcctcagccctggcaccagctctggccgcaaccctgaccctggctctgggccgggcactctgccggatcccagctccaaacccctccccggctccagatccacccccagccctactcctgtggaatcttctgacccaaaggctgggcacgacgctggtcccgaccttgtgcccagcccagaccttgatcctgtgcccagcccagaccctgatcctgtgcccagccctgatcccaaccctgtgtcctgccctgacccctgttctcccactcgtggcactgtcagcccagccctccctaccggcgagagtccagagtgggtacaggagcaaggggcactgctggggcctgatggctgaaggagacgccggcatcctcgggggcctggggaagttgtgtgttgtgcagtcagtaaaatcctcccactgccgg

SEQ ID NO: 307468 - DNA, 900 bp, Homo sapiens
cgggagcgcctggcggggccgctgggccgagggggccgccggcggggctggcgggcggggggcttcctgcgggcccggggggagccggcggccggcgcgggcgcggcgggccgggcaggggcgaggggcgccgggtcttgccccagaagctgcgggcacatccacgcctgaaatgcggcgctcagtcctggtcaggaacccaggccacaaaggcctgagacccgtttatgaagagctcgactctgactccgaggacctagaccccaatcctgaagatctggacccggtttctgaagacccagagcctgatcctgaagacctcaacactgtcccggaagacgtggaccccagctatgaagatctggagcccgtctcggaggatctggaccccgacgccgaagctccgggctcggaaccccaagatcccgaccccatgtcttcgagtttcgacctcgatccagatgtgattggccccgtacccctgattctcgatcctaacagcgacaccctcagccccggcgatccaaaagtggaccccatctcctctggcctcactgccaccccccaggtcttgccccagccctactcctgtggaatcttctgacccaaaggctgggcacgacgctggtcccgaccttgtgcccagcccagaccttgatcctgtgcccagcccagaccctgatcctgtgcccagccctgatcccaaccctgtgtcctgccctgacccctgttctcccactcgtggcactgtcagcccagccctccctaccggcgagagtccagagtgggtacaggagcaaggggcactgctggggcctgatggctgaaggagacgccggcatcctcgggggcctggggaagttgtgtgttgtgcagtcagtaaaatcctcccactgccgg

SEQ ID NO: 307469 - DNA, 1007 bp, Homo sapiens
gagccaaagctactcaaacgcttcttcaagaccaccatgggctcggactactgcccttcagagtggagacaggtgcagaaagcgcccaacctccacttgcagcaaagcaacctgccgcggggcacgggcgaattcgattttttaaccatgaaccagaagatgctgaagccacacagaacacctccggccccggtgactgaagagatgctacagcgggtaataattcctaaattagtcaagactgtcacggatgcaaagaacagacatccactaaaaccagctcaaacacccagaacatttgttggtttgtggtacaggaaagaatgagttctgtggcttcaggtcttgccccagaagctgcgggcacatccacgcctgaaatgcggcgctcagtcctggtcaggaacccaggccacaaaggcctgagacccgtttatgaagagctcgactctgactccgaggacctagaccccaatcctgaagatctggacccggtttctgaagacccagagcctgatcctgaagacctcaacactgtcccggaagacgtggaccccagctatgaagatctggagcccgtctcggaggatctggaccccgacgccgaagctccgggctcggaaccccaagatcccgaccccatgtcttcgagtttcgacctcgatccagatgtgattggccccgtacccctgattctcgatcctaacagcgacaccctcagccccggcgatccaaaagtggaccccatctcctctggccttcacatggcacaaaaaagagaataggaaaaaagaaaaaagaaaagaaaacagaaaaaagaaaaaaaaaaaagaaaaagagaagagaacaacaggaagaaagaagagaacagaagaagaagacagaacagaccaagggaaaaagagagacagagaggaaagaaggagagaaaagagagagagagagagaaggagaggagaaaagacgatcgacggagaagagaaaagagaaaaaaagagaagaggaag

SEQ ID NO: 307470 - DNA, 468 bp, Homo sapiens
gagccaaagctactcaaacgcttcttcaagaccaccatgggctcggactactgcccttcagagtggagacaggtgcagaaagcgcccaacctccacttgcagcaaagcaacctgccgcggggcacgggcgaattcgattttttaaccatgaaccagaagatgctgaagccacacagaacacctccggccccggtgactgaagagatgctacagcggtgcaagtacagccacatggagccccctctgggtggactgcgcttcttctcaacacaatacaaggacgagtttcctttcaagtaccagggcccagcagccctgagactgaaaaatcctcaggagggcttcgtgcccctgggcacgcctcaccagcgcggctgcagggagaagatagaccctctggtcccccagccccctatgtacctgtgccccagccagcaataaatgccatcttggcaacattccaaactt

SEQ ID NO: 307471 - DNA, 1703 bp, Homo sapiens
gtgcctctgctccgtccgccttcgaggagaggtcggcatctttgttccctgcccggccattgttcgtgccgcgcttctagcaacgccgggccggtaaccccctctccctccttgcgcgttccgggtctcgcaagcgcctccaaggtttgtcttgaagcatagctccagctggagggtaccttttaagctgttcaaggtcaagatgaatacaaactcaaaggaggttttatccctgggtgttcaagttcccgaggcatgggaagaacttctgacaatgaaagtggaagcaaaaagtcaccttcaatggcaggaatccagactgaaacgcagtaatccactggcaagggaaatcttccgaaggcactttcgacagctgtgctaccaagagacccctggaccaagggaggctcttactcgactccaggaactttgctaccagtggttgaggccacatgtgagcacaaaggagcagattttggatctgctggtgctggagcagtttctatccattctgcccaaggagctccagggctgggtgagggaacactgtccagagagtggagaagaggctgtgattttgctggaggatctggagagagagctcgatgaaccacaacatgagatggtggcccacagacacagacaagaagtcctctgtaaagagatggtgcctctagcagagcagacaccactgacccttcagtcccagcctaaggagccacagctcacatgtgactctgctcagaagtgccattctattggagagacagatgaagtaaccaagactgaggacagagagttggtgctaaggaaagactgtcctaagatagtggaaccacatgggaaaatgtttaatgagcagacctgggaggtatcacagcaggatccctcacatggagaagttggtgaacataaggataggatagagaggcagtggggaaacctcttaggagaggggcaacacaaatgtgatgaatgtgggaagagctttactcagagctcaggtctcattcgacatcaaagaattcatactggagaaagaccttatgaatgtaatgaatgtgggaaagccttcagtcgaagttctggtctttttaatcaccgaggaatccacaatatacagaaacggtaccactgcaaggagtgtgggaaggtcttcagtcagagtgcgggtcttatccagcatcagagaatccacaaaggagaaaagccgtatcagtgcagccagtgcagtaagagctacagtcggcgttcatttctcattgaacatcagagaagccacacaggggagcgacctcaccagtgcattgaatgtgggaaaagctttaatcgacactgcaacctcattcgccatcagaagatccacacagtggctgagctggtctagggcttggctatgagcaagttttccagatcaccacccaagttgtgtggggcaggttgagactagaaaatgcctctttcttcctttctccatgaaatgtgtttgaaacaaatcctgacttaaggcccagggacttccttaaaggaaagttgggtgtttgaagctactgttttctcttttgttcgttttacctctttcttactcttactagctgtgtccctcttatttataatttatttatttttttgagatggctgctaaacccttctaataatataataaatggcactgccacagccaacatgcctgaaaaaaaaaa

SEQ ID NO: 307472 - DNA, 874 bp, Homo sapiens
gtgcctctgctccgtccgccttcgaggagaggtcggcatctttgttccctgcccggccattgttcgtgccgcgcttctagcaacgccgggccggtaaccccctctccctccttgcgcgttccgggtctcgcaagcgcctccaaggtttgtcttgaagcatagctccagctggagggtaccttttaagctgttcaaggtcaagatgaatacaaactcaaaggaggttttatccctgggtgttcaagttcccgaggcatgggaagaacttctgacaatgaaagtggaagcaaaaagtcaccttcaatggcaggaatccagactgaaacgcagtaatccactggcaagggaaatcttccgaaggcactttcgacagctgtgctaccaagagacccctggaccaagggaggctcttactcgactccaggaactttgctaccagtggttgaggccacatgtgagcacaaaggagcagattttggatctgctggtgctggagcagtttctatccattctgcccaaggagctccagggctgggtgagggaacactgtccagagagtggagaagaggctgtgattttgctggaggatctggagagagagctcgatgaaccacaacatgagatggtggcccacagacacagacaagaagtcctctgtaaagagatggtgcctctagcagagcagacaccactgacccttcagtcccagcctaaggagccacagctcacatgtgactctgctcagaagtgccattctattggagagacaggtgagggacagcatttatttgatgttgaacgaatcccacctggtcaagcaaaaacaaacaataaacccagagctgggaaaacaggagacccaaagactccttac

SEQ ID NO: 307473 - DNA, 898 bp, Homo sapiens
gtgcctctgctccgtccgccttcgaggagaggtcggcatctttgttccctgcccggccattgttcgtgccgcgcttctagcaacgccgggccggtaaccccctctccctccttgcgcgttccgggtctcgcaagcgcctccaaggtttgtcttgaagcatagctccagctggagggtaccttttaagctgttcaaggtcaagatgaatacaaactcaaaggaggttttatccctgggtgttcaagttcccgaggcatgggaagaacttctgacaatgaaagtggaagcaaaaagtcaccttcaatggcaggaatccagactgaaacgcagtaatccactggcaagggaaatcttccgaaggcactttcgacagctgtgctaccaagagacccctggaccaagggaggctcttactcgactccaggaactttgctaccagtggttgaggccacatgtgagcacaaaggagcagattttggatctgctggtgctggagcagtttctatccattctgcccaaggagctccagggctgggtgagggaacactgtccagagagtggagaagaggctgtgattttgctggaggatctggagagagagctcgatgaaccacaacatgagatggtggcccacagacacagacaagaagtcctctgtaaagagatggtgcctctagcagagcagacaccactgacccttcagtcccagcctaaggagccacagctcacatgtgactctgctcagaagtgccattctattggagagacagacttctccctgagtaccaccctggaagctttctggacttctgatgcatggtacatgaggaaggctttcagggatcgctgtggagcacagcttcagagaatggacttcaaggtttgacagacaggttca

SEQ ID NO: 307474 - DNA, 1483 bp, Homo sapiens
ataccacagactggttgtctttaacagaaatttattttctcacattttcaaaggctagtagtccaagatcaagataccatcaggtttggtttctggtgaggcctcttcctggcttatagatggccatcttcttgctgtatcctcacatggcctttcttctgtatgcatacagagagagagcaagctctctcatcttataaggacagataccattcctacccgatagggcccttccttataacctcatttaacttttaataccttcctcaaggccctatctccaaatataatcatattgaggggttaggacctcagcatatgtgagggaatacaatttagtccgtaaccagtatgtacctcagaaagtcattgtgagtatcaaatacaatttatgaaaagcacttggcatgcattatgcttaatacatggtcactattgtcacaaatcaccagtgccacccttgctgatttgggttcatacttggagtagaaagatatcagatatgcttagtaagtggcagaactgtatgggagaatccagtgaaatcagactttgccatttccttctctgtaatcttctgagtggtggcagtgaccacccttgtggatatagtactgagcacttgggactgagtcagctgctttcccattctagccctccctgcaggaattggctctagcttgtctgatttcccacacataaaatcatgccctcttactgactttttgttaatgttctgacaatcaatctgtagcaaggttctactgttttcagtttcatattacccctatatgcatcaaagctgcaacttcccttgcctctttgtccctaggttctgtttatttcatttaccctagcaattatggatttctattacatggaactcatctcttgatttaaattaaagtgtatgtgttgagtaaattctgtgcagaccttcttatagcttctgtgactttatcagattaaaattgcttctgatatcattttccctctttatgagcatctttccagtcaatttgtttctttcttcttcctctctctatgaacttggaccttttattttctagccacttcctttcttctaccttccaaactgcatctagaaccctgctgagtatccccttttccaagaagcacatctatattttccacctatccacttatctatccatctatcattcaacaagtgtttattaagcatctactatggctgtaggagaatatccagagggcatctggagactggagtgttctccttgtaggatatcagcgcaggtatgtgttacaaatttagataaagccaatattataaaacaacatagtgtttgaaattacaaggaccaaattcaagttccagcttttcaaattcttagccaagcaatatttaataggtaagcttgagtttctttttaagttatgctgattatttaaaaatccaaataatacaaaagtttatatagtaaaaaatggaagttttcca

SEQ ID NO: 307475 - DNA, 863 bp, Homo sapiens
gtgcctctgctccgtccgccttcgaggagaggtcggcatctttgttccctgcccggccattgttcgtgccgcgcttctagcaacgccgggccggcaagcgcctccaaggtttgtcttgaagcatagctccagctggagggtaccttttaagctgttcaaggtcaagatgaatacaaactcaaaggaggttttatccctgggtgttcaagttcccgaggcatgggaagaacttctgacaatgaaagtggaagcaaaaagtcaccttcaatggcaggaatccagactgaaacgcagtaatccactggcaagggaaatcttccgaaggcactttcgacagctgtgctaccaagagacccctggaccaagggaggctcttactcgactccaggaactttgctaccagtggttgaggccacatgtgagcacaaaggagcagattttggatctgctggtgctggagcagtttctatccattctgcccaaggagctccagggctgggtgagggaacactgtccagagagtggagaagaggctgtgattttgctggaggatctggagagagagctcgatgaaccacaacatgagtcaaatcttgtctttttgtccccagatggtggcccacagacacagacaagaagtcctctgtaaagagatggtgcctctagcagagcagacaccactgacccttcagtcccagcctaaggagccacagctcacatgtgactctgctcagaagtgccattctattggagagacaggtgagggacagcatttatttgatgttgaacgaatcccacctggtcaagcaaaaacaaacaataaacccagagctgggaaaacaggagacccaaagactccttac

SEQ ID NO: 307476 - DNA, 1790 bp, Homo sapiens
gtgcctctgctccgtccgccttcgaggagaggtcggcatctttgttccctgcccggccattgttcgtgccgcgcttctagcaacgccgggccggtaaccccctctccctccttgcgcgttccgggtctcgcaagcgcctccaaggtttgtcttgaagcatagctccagctggagggtaccttttaagctgttcaaggtcaagatgaatacaaactcaaaggaggttttatccctgggtgttcaagttcccgaggcatgggaagaacttctgacaatgaaagtggaagcaaaaagtcaccttcaatggcaggaatccagactgaaacgcagtaatccactggcaagggaaatcttccgaaggcactttcgacagctgtgctaccaagagacccctggaccaagggaggctcttactcgactccaggaactttgctaccagtggttgaggccacatgtgagcacaaaggagcagattttggatctgctggtgctggagcagtttctatccattctgcccaaggagctccagggctgggtgagggaacactgtccagagagtggagaagaggctgtgattttgctggaggatctggagagagagctcgatgaaccacaacatgagatggtggcccacagacacagacaagaagtcctctgtaaagagatggtgcctctagcagagcagacaccactgacccttcagtcccagcctaaggagccacagctcacatgtgactctgctcagaagtgccattctattggagagacagacacatttttattttccaaacctgttgtgatcccccagctaaaaggaggaggagaaacatggcctaacaacagaggagtcctaagagatgaagtaaccaagactgaggacagagagttggtgctaaggaaagactgtcctaagatagtggaaccacatgggaaaatgtttaatgagcagacctgggaggtatcacagcaggatccctcacatggagaagttggtgaacataaggataggatagagaggcagtggggaaacctcttaggagaggggcaacacaaatgtgatgaatgtgggaagagctttactcagagctcaggtctcattcgacatcaaagaattcatactggagaaagaccttatgaatgtaatgaatgtgggaaagccttcagtcgaagttctggtctttttaatcaccgaggaatccacaatatacagaaacggtaccactgcaaggagtgtgggaaggtcttcagtcagagtgcgggtcttatccagcatcagagaatccacaaaggagaaaagccgtatcagtgcagccagtgcagtaagagctacagtcggcgttcatttctcattgaacatcagagaagccacacaggggagcgacctcaccagtgcattgaatgtgggaaaagctttaatcgacactgcaacctcattcgccatcagaagatccacacagtggctgagctggtctagggcttggctatgagcaagttttccagatcaccacccaagttgtgtggggcaggttgagactagaaaatgcctctttcttcctttctccatgaaatgtgtttgaaacaaatcctgacttaaggcccagggacttccttaaaggaaagttgggtgtttgaagctactgttttctcttttgttcgttttacctctttcttactcttactagctgtgtccctcttatttataatttatttatttttttgagatggctgctaaacccttctaataatataataaatggcactgccacagccaacatgcctgaaaaaaaaaa

SEQ ID NO: 307477 - DNA, 1667 bp, Homo sapiens
gtgcctctgctccgtccgccttcgaggagaggtcggcatctttgttccctgcccggccattgttcgtgccgcgcttctagcaacgccgggccggcaagcgcctccaaggtttgtcttgaagcatagctccagctggagggtaccttttaagctgttcaaggtcaagatgaatacaaactcaaaggaggttttatccctgggtgttcaagttcccgaggcatgggaagaacttctgacaatgaaagtggaagcaaaaagtcaccttcaatggcaggaatccagactgaaacgcagtaatccactggcaagggaaatcttccgaaggcactttcgacagctgtgctaccaagagacccctggaccaagggaggctcttactcgactccaggaactttgctaccagtggttgaggccacatgtgagcacaaaggagcagattttggatctgctggtgctggagcagtttctatccattctgcccaaggagctccagggctgggtgagggaacactgtccagagagtggagaagaggctgtgattttgctggaggatctggagagagagctcgatgaaccacaacatgagatggtggcccacagacacagacaagaagtcctctgtaaagagatggtgcctctagcagagcagacaccactgacccttcagtcccagcctaaggagccacagctcacatgtgactctgctcagaagtgccattctattggagagacagatgaagtaaccaagactgaggacagagagttggtgctaaggaaagactgtcctaagatagtggaaccacatgggaaaatgtttaatgagcagacctgggaggtatcacagcaggatccctcacatggagaagttggtgaacataaggataggatagagaggcagtggggaaacctcttaggagaggggcaacacaaatgtgatgaatgtgggaagagctttactcagagctcaggtctcattcgacatcaaagaattcatactggagaaagaccttatgaatgtaatgaatgtgggaaagccttcagtcgaagttctggtctttttaatcaccgaggaatccacaatatacagaaacggtaccactgcaaggagtgtgggaaggtcttcagtcagagtgcgggtcttatccagcatcagagaatccacaaaggagaaaagccgtatcagtgcagccagtgcagtaagagctacagtcggcgttcatttctcattgaacatcagagaagccacacaggggagcgacctcaccagtgcattgaatgtgggaaaagctttaatcgacactgcaacctcattcgccatcagaagatccacacagtggctgagctggtctagggcttggctatgagcaagttttccagatcaccacccaagttgtgtggggcaggttgagactagaaaatgcctctttcttcctttctccatgaaatgtgtttgaaacaaatcctgacttaaggcccagggacttccttaaaggaaagttgggtgtttgaagctactgttttctcttttgttcgttttacctctttcttactcttactagctgtgtccctcttatttataatttatttatttttttgagatggctgctaaacccttctaataatataataaatggcactgccacagccaacatgcctgaaaaaaaaaa

SEQ ID NO: 307478 - DNA, 1159 bp, Homo sapiens
acaaaacaaaaaacaacgactcaggccaagtctacatggggatggactgacctgcattatgccaaagagggcaaacgttcctccctacgtaggggaaagtgttaccacactagcccttctgtttctagcccacttccttttctatgatatatttttatagacatagtcaccttcccataggctcagggaacaagtgacatttacctagcctttttctttgtttcagatgaagtaaccaagactgaggacagagagttggtgctaaggaaagactgtcctaagatagtggaaccacatgggaaaatgtttaatgagcagacctgggaggtatcacagcaggatccctcacatggagaagttggtgaacataaggataggatagagaggcagtggggaaacctcttaggagaggggcaacacaaatgtgatgaatgtgggaagagctttactcagagctcaggtctcattcgacatcaaagaattcatactggagaaagaccttatgaatgtaatgaatgtgggaaagccttcagtcgaagttctggtctttttaatcaccgaggaatccacaatatacagaaacggtaccactgcaaggagtgtgggaaggtcttcagtcagagtgcgggtcttatccagcatcagagaatccacaaaggagaaaagccgtatcagtgcagccagtgcagtaagagctacagtcggcgttcatttctcattgaacatcagagaagccacacaggggagcgacctcaccagtgcattgaatgtgggaaaagctttaatcgacactgcaacctcattcgccatcagaagatccacacagtggctgagctggtctagggcttggctatgagcaagttttccagatcaccacccaagttgtgtggggcaggttgagactagaaaatgcctctttcttcctttctccatgaaatgtgtttgaaacaaatcctgacttaaggcccagggacttccttaaaggaaagttgggtgtttgaagctactgttttctcttttgttcgttttacctctttcttactcttactagctgtgtccctcttatttataatttatttatttttttgagatggctgctaaacccttctaataatataataaatggcactgccacagccaacatgcctgaaaaaaaaaa

SEQ ID NO: 307479 - DNA, 1188 bp, Homo sapiens
gtgcctctgctccgtccgccttcgaggagaggtcggcatctttgttccctgcccggccattgttcgtgccgcgcttctagcaacgccgggccggtaaccccctctccctccttgcgcgttccgggtctcgcaagcgcctccaaggtttgtcttgaagcatagctccagctggagggtaccttttaagctgttcaaggtcaagatgaatacaaactcaaaggaggttttatccctgggtgttcaagttcccgaggcatgggaagaacttctgacaatgaaagtggaagcaaaaagtcaccttcaatggcaggaatccagactgaaacgcagtaatccactggcaagggaaatcttccgaaggcactttcgacagctgtgctaccaagagacccctggaccaagggaggctcttactcgactccaggaactttgctaccagtggttgaggccacatgtgagcacaaaggagcagattttggatctgctggtgctggagcagtttctatccattctgcccaaggagctccagggctgggtgagggaacactgtccagagagtggagaagaggctgtgattttgctggaggatctggagagagagctcgatgaaccacaacatgagatggtggcccacagacacagacaagaagtcctctgtaaagagatggtgcctctagcagagcagacaccactgacccttcagtcccagcctaaggagccacagctcacatgtgactctgctcagaagtgccattctattggagagacagatgaagtaaccaagactgaggacagagagttggtgctaaggaaagactgtcctaagatagtggaaccacatgggaaaatgtttaatgagcagactggtctagggcttggctatgagcaagttttccagatcaccacccaagttgtgtggggcaggttgagactagaaaatgcctctttcttcctttctccatgaaatgtgtttgaaacaaatcctgacttaaggcccagggacttccttaaaggaaagttgggtgtttgaagctactgttttctcttttgttcgttttacctctttcttactcttactagctgtgtccctcttatttataatttatttatttttttgagatggctgctaaacccttctaataatataataaatggcactgccacagccaacatgcctgaaaaaaaaaa

SEQ ID NO: 307480 - DNA, 351 bp, Homo sapiens
cagatagcagtaatggtcagttcttctgagagcctagtgtgctcatctttgacccttctccctgcgtgcagacttctccctgagtaccaccctggaagctttctggacttctgatgcatggtacatgaggaaggctttcagggatcgctgtggagcacagcttcagagaatggacttcaaggtttgacagacaggttcagatcctggcatcgcctcatggaagctgcttgtattgggcagattacttaaccacttgacctcagatccctcatctacaaaatggggttgataatagctttggtttagtctacttgcgctgccttaagagaataccacagactggttgtcttt

SEQ ID NO: 307481 - DNA, 268 bp, Homo sapiens
ggccattgttcgtgccgcgcttctagcaacgccgggccggtaaccccctctccctccttgcgcgttccgggtctcgtgagttggctgtggggaccgggaatggaggcgggtcagggagggtggggctggaaaaggggtgtggaaagtgaacctcagccgctgggaagtgggagccggaggagggggcggcggtcagtgccgggcggcttcgggcgtcccctagaccagagtggtcatccccagctgtggggacattgtacaagaaagg

SEQ ID NO: 307482 - DNA, 656 bp, Homo sapiens
ctaaaagaagtcactgatcttatgatctgttatattttgtaaggttgtgatgctctaccatccagaaatatttttagccaaaatatacaaaccatatgcctagttcattaaaatgaaaccaagtccagtatgaacatgatcagaataatataaatatattttgatttcttctttaaattttgaatcaattgggcttcagtttggaggctgctgtatgggtgtgtttaaacaatttatgatttccaagatcatatccccagttttcaggaggaaatgaaattggatgaaaagcaaaggagtaaccattgatagaataactttctacagaggaaagaactgaaaaggaaagatgccgactcgagtctctaaaggtcttgcacttcattggattccagtaattgactccggagtgagtgagacgatgatttccagtggccttgtttgcagccggcagcctctggtttcagtccctgagaggagcgtcccagttagtgttgctgagcaacagcatgctgggttgagagctggaatgtgaagggttgcaaaacgatttttaaaataaacacacaacttcccatcagcatgaagcaagccaaagggagagaagtactaagcactacactgtgacaggtggtgaggcagaattgaaagggaaa

SEQ ID NO: 307483 - DNA, 289 bp, Homo sapiens
tcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgaacaaacaaatgcaagaataagaacaagaaatgaaagtcccctctcatagagagccgacattccagtggaggagacagagaatgagttctaaatgagcaaaatacatagtgcgttagatggtgttgactgctaaggagaaagaaacag

SEQ ID NO: 307484 - DNA, 1737 bp, Homo sapiens
tcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtctttttttaaatgtgctgtgtaaagttagtcctactccttaagccatcttggtaaatttccccaaccagtgtgaagttagaattcctttcagggtgatgccaggttctatttggaatttatatacaacctgcttgggtggagaagctattgtcttcggaaaccttggtgtagttgaactgatagttactgttgtgacctgaagttcaccattaaaagggattacccaagcaaaatcatggaattattggttataaaagtgattgttggcacatcctatgcaatatatctaaattgaataatggtaccagataaaattatagatgggaatgaagcttgtgtatcatccattatcatgtgtaatcaataaacgatttaattctctgga

SEQ ID NO: 307485 - DNA, 1358 bp, Homo sapiens
tcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtctttttt

SEQ ID NO: 307486 - DNA, 311 bp, Homo sapiens
aaaaaaacaaatgcaggatatccatgcatttccgtacaaccggatagtattcagctctaaaaagtattattcagctgctgatacatgctacatcatgctcagagaaagaaggcagtcacagaggatcacatattgtaggattccatttatgtgaaatgtccagaataggcaaattcatagagatagaaagtcaattagtggttgcaaggggctaggggtgaagggtagggggaaagggagtgactgctaatgggcacagcatttcttttattggggggataaagctgttctaaaattagatgttgatgatg

SEQ ID NO: 307487 - DNA, 189 bp, Homo sapiens
agcttctaacgatgtacgggtagtccatgttaatagtggggctttcaggtgtttagagattttttttgttgttgttaacattcattgcaaaagtactagatggtgtataactctagagttgaattttaagggattccctaatatgtatactatctttttatctgaagtaataaataaacaatgatcttg

SEQ ID NO: 307488 - DNA, 2714 bp, Homo sapiens
cgtcagccggggccgccatattggaaaggcgccgccgccgcctccgccttggagctcggggtgtttcggggactgcggccacaggcaggaaggcgctcctctcctgccccgccgacgcccggccagcccgcttcgccctgacctgtttcctcatgactgcccccggccctgctgccgacggacgtcgccccggcgtccggatttaacacggaaacccggatcggaggccgcgcggggaggaggagggcgacccggtcggtcctgcgaccctctcggcccggctcggcgcctcggcgggagccatgacctcgctgacccagcgcagctccggcctggtgcagcggcgcaccgaggcctcccgcaacgccgccgacaaggagcgggcggcgggcggcggcgccggcagcagcgaggacgacgcgcagagccgccgcgacgagcaggacgacgacgacaagggcgactccaaggaaacgcggctgaccctgatggaggaagtgctcctgctgggcctcaaggaccgcgagggttacacatcattttggaatgactgtatatcatctggattacgtggctgtatgttaattgaattagcattgagaggaaggttacaactagaggcttgtggaatgagacgtaaaagtctattaacaagaaaggtaatctgtaagtcagatgctccaacaggggatgttcttcttgatgaagctctgaagcatgttaaggaaactcagcctccagaaacggtccagaactggattgaattacttagtggtgagacatggaatccattaaaattgcattatcagttaagaaatgtacgggaacgattagctaaaaacctggtggaaaagggtgtattgacaacagagaaacagaacttcctactttttgacatgacaacacatcccctcaccaataacaacattaagcagcgcctcatcaagaaagtacaggaagccgttcttgacaaatgggtgaatgaccctcaccgcatggacaggcgcttgctggccctcatttacctggctcatgcctcggacgtcctggagaatgcttttgctcctcttctggacgagcagtatgatttggctaccaagagagtgcggcagcttctcgacttagaccctgaagtggaatgtctgaaggccaacaccaatgaggttctgtgggcggtggtggcggcgttcaccaagtaactctgctcggggtgaaccattctcctttctctcaagtaaaccagtagtttttcttctgttgacttctggttttctgtaatttgtactttcccacactataattggcttctgttttacaaaatggtgggtggctttttcttttttgtacgtgtacaggattctgctggtacgagaggccttcctctttctgtttttaaaaaaagttttactgccatattggcattccattccctgttgccatcctcactgttacctgttttgggtttctggtctactttgactttcaaagtacctccagcctcctcatacgcacagcttttggatgacctcagcttgagtttctccatatgtgcatgtacatctagcattctgcctacagttcagacagaagtcacaaaaaggccttcaactcaccaaaggtaaatatctgtatctattaggacattttttacatagacttcagttgagatgtatacttagcaaaattatttttaaattgaaacagcacagtaaatacttaatataaaatgtcccttggattttgcttcccatgtaaatctattgtattattacacttgttataattttaactataaaggtccaattgtttcacagagccagtttgggatgggctgcattccatttatgctgtatatagtttgaattatatataaattaccccttcttctggccacccctgctcccatcttagtattttgcaagatctaatcagttgtacacctggtgcccctcgcttgcttcaatcatggttatttgatggcaaaatcgacctcttgtcgctgaaggagagagaaaagatgtgtgtctgattggtcctgggattttttgagctgtgccatttatggtactctttgcctatgcatcccctttttagattttttttaaattttatcttactgtttttataatttctattgggaagaggcttgtgaccagtaccaatcttgagtttctttttctgtccacaagtaaattaatatctgctctgaaatgtcatttatctactcacacattcttggggaaaaaaatcaaatgtcagtcctagcagatgttgcatgtaaattggtagcaagtaatgattacaacccagaggattaagaattttgtaacagaaagctctatgttttaattttttatatacaattaggataattagcattgtcagactataaacctttgctttttaaagtttatttttactatttctttatcactttattgtatcatcaccattggtttcataatgtaaatactatatgttgaacaaattaaatgtcaaaattttttattaccatagtccatgttaatagtggggctttcaggtgtttagagattttttttgttgttgttaacattcattgcaaaagtactagatggtgtataactctagagttgaattttaagggattccctaatatgtatactatctttttatctgaagtaataaataaacaatgatcttgaaagtgcctgaatcagagcaagcaaaaaaat

SEQ ID NO: 307489 - DNA, 2683 bp, Homo sapiens
cgtcagccggggccgccatattggaaaggcgccgccgccgcctccgccttggagctcggggtgtttcggggactgcggccacaggcaggaaggcgctcctctcctgccccgccgacgcccggccagcccgcttcgccctgacctgtttcctcatgactgcccccggccctgctgccgacggacgtcgccccggcgtccggatttaacacggaaacccggatcggaggccgcgcggggaggaggagggcgacccggtcggtcctgcgaccctctcggcccggctcggcgcctcggcgggagccatgacctcgctgacccagcgcagctccggcctggtgcagcggcgcaccgaggcctcccgcaacgccgccgacaaggagcgggcggcgggcggcggcgccggcagcagcgaggacgacgcgcagagccgccgcgacgagcaggacgacgacgacaagggcgactccaaggaaacgcggctgaccctgatggaggaagtgctcctgctgggcctcaaggaccgcgagggttacacatcattttggaatgactgtatatcatctggattacgtggctgtatgttaattgaattagcattgagaggaaggttacaactagaggcttgtggaatgagacgtaaaagtctattaacaagaaaggtaatctgtaagtcagatgctccaacaggggatgttcttcttgatgaagctctgaagcatgttaaggaaactcagcctccagaaacggtccagaactggattgaattacttagtggtgagacatggaatccattaaaattgcattatcagttaagaaatgtacgggaacgattagctaaaaacctggtggaaaagggtgtattgacaacagagaaacagaacttcctactttttgacatgacaacacatcccctcaccaataacaacattaagcagcgcctcatcaagaaagtacaggaagccgttcttgacaaatgggtgaatgaccctcaccgcatggacaggcgcttgctggccctcatttacctggctcatgcctcggacgtcctggagaatgcttttgctcctcttctggacgagcagtatgatttggctaccaagagagtgcggcagcttctcgacttagaccctgaagtggaatgtctgaaggccaacaccaatgaggttctgtgggcggtggtggcggcgttcaccaagtaactctgctcggggtgaaccattctcctttctctcaagtaaaccagtagtttttcttctgttgacttctggttttctgtaatttgtactttcccacactataattggcttctgttttacaaaatggtgggtggctttttcttttttgtacgtgtacaggattctgctggtacgagaggccttcctctttctgtttttaaaaaaagttttactgccatattggcattccattccctgttgccatcctcactgttacctgttttgggtttctggtctactttgactttcaaagtacctccagcctcctcatacgcacagcttttggatgacctcagcttgagtttctccatatgtgcatgtacatctagcattctgcctacagttcagacagaagtcacaaaaaggccttcaactcaccaaaggtaaatatctgtatctattaggacattttttacatagacttcagttgagatgtatacttagcaaaattatttttaaattgaaacagcacagtaaatacttaatataaaatgtcccttggattttgcttcccatgtaaatctattgtattattacacttgttataattttaactataaaggtccaattgtttcacagagccagtttgggatgggctgcattccatttatgctgtatatagtttgaattatatataaattaccccttcttctggccacccctgctcccatcttagtattttgcaagatctaatcagttgtacacctggtgcccctcgcttgcttcaatcatggttatttgatggcaaaatcgacctcttgtcgctgaaggagagagaaaagatgtgtgtctgattggtcctgggattttttgagctgtgccatttatggtactctttgcctatgcatcccctttttagattttttttaaattttatcttactgtttttataatttctattgggaagaggcttgtgaccagtaccaatcttgagtttctttttctgtccacaagtaaattaatatctgctctgaaatgtcatttatctactcacacattcttggggaaaaaaatcaaatgtcagtcctagcagatgttgcatgtaaattggtagcaagtaatgattacaacccagaggattaagaattttgtaacagaaagctctatgttttaattttttatatacaattaggataattagcattgtcagactataaacctttgctttttaaagtttatttttactatttctttatcactttattgtatcatcaccattggtttcataatgtaaatactatatgttgaacaaattaaatgtcaaaattttttattaccatagtccatgttaatagtggggctttcaggtgtttagagattttttttgttgttgttaacattcattgcaaaagtactagatggtgtataactctagagttgaattttaagggattccctaatatgtatactatctttttatctgaagtaataaataaacaatgatcttg

SEQ ID NO: 307490 - DNA, 2671 bp, Homo sapiens
cgtcagccggggccgccatattggaaaggcgccgccgccgcctccgccttggagctcggggtgtttcggggactgcggccacaggcaggaaggcgctcctctcctgccccgccgacgcccggccagcccgcttcgccctgacctgtttcctcatgactgcccccggccctgctgccgacggacgtcgccccggcgtccggatttaacacggaaacccggatcggaggccgcgcggggaggaggagggcgacccggtcggtcctgcgaccctctcggcccggctcggcgcctcggcgggagccatgacctcgctgacccagcgcagctccggcctggtgcagcggcgcaccgaggcctcccgcaacgccgccgacaaggagcgggcggcggggacgagcaggacgacgacgacaagggcgactccaaggaaacgcggctgaccctgatggaggaagtgctcctgctgggcctcaaggaccgcgagggttacacatcattttggaatgactgtatatcatctggattacgtggctgtatgttaattgaattagcattgagaggaaggttacaactagaggcttgtggaatgagacgtaaaagtctattaacaagaaaggtaatctgtaagtcagatgctccaacaggggatgttcttcttgatgaagctctgaagcatgttaaggaaactcagcctccagaaacggtccagaactggattgaattacttagtggtgagacatggaatccattaaaattgcattatcagttaagaaatgtacgggaacgattagctaaaaacctggtggaaaagggtgtattgacaacagagaaacagaacttcctactttttgacatgacaacacatcccctcaccaataacaacattaagcagcgcctcatcaagaaagtacaggaagccgttcttgacaaatgggtgaatgaccctcaccgcatggacaggcgcttgctggccctcatttacctggctcatgcctcggacgtcctggagaatgcttttgctcctcttctggacgagcagtatgatttggctaccaagagagtgcggcagcttctcgacttagaccctgaagtggaatgtctgaaggccaacaccaatgaggttctgtgggcggtggtggcggcgttcaccaagtaactctgctcggggtgaaccattctcctttctctcaagtaaaccagtagtttttcttctgttgacttctggttttctgtaatttgtactttcccacactataattggcttctgttttacaaaatggtgggtggctttttcttttttgtacgtgtacaggattctgctggtacgagaggccttcctctttctgtttttaaaaaaagttttactgccatattggcattccattccctgttgccatcctcactgttacctgttttgggtttctggtctactttgactttcaaagtacctccagcctcctcatacgcacagcttttggatgacctcagcttgagtttctccatatgtgcatgtacatctagcattctgcctacagttcagacagaagtcacaaaaaggccttcaactcaccaaaggtaaatatctgtatctattaggacattttttacatagacttcagttgagatgtatacttagcaaaattatttttaaattgaaacagcacagtaaatacttaatataaaatgtcccttggattttgcttcccatgtaaatctattgtattattacacttgttataattttaactataaaggtccaattgtttcacagagccagtttgggatgggctgcattccatttatgctgtatatagtttgaattatatataaattaccccttcttctggccacccctgctcccatcttagtattttgcaagatctaatcagttgtacacctggtgcccctcgcttgcttcaatcatggttatttgatggcaaaatcgacctcttgtcgctgaaggagagagaaaagatgtgtgtctgattggtcctgggattttttgagctgtgccatttatggtactctttgcctatgcatcccctttttagattttttttaaattttatcttactgtttttataatttctattgggaagaggcttgtgaccagtaccaatcttgagtttctttttctgtccacaagtaaattaatatctgctctgaaatgtcatttatctactcacacattcttggggaaaaaaatcaaatgtcagtcctagcagatgttgcatgtaaattggtagcaagtaatgattacaacccagaggattaagaattttgtaacagaaagctctatgttttaattttttatatacaattaggataattagcattgtcagactataaacctttgctttttaaagtttatttttactatttctttatcactttattgtatcatcaccattggtttcataatgtaaatactatatgttgaacaaattaaatgtcaaaattttttattaccatagtccatgttaatagtggggctttcaggtgtttagagattttttttgttgttgttaacattcattgcaaaagtactagatggtgtataactctagagttgaattttaagggattccctaatatgtatactatctttttatctgaagtaataaataaacaatgatcttgaaagtgcctgaatcagagcaagcaaaaaaat

SEQ ID NO: 307491 - DNA, 2629 bp, Homo sapiens
cgtcagccggggccgccatattggaaaggcgccgccgccgcctccgccttggagctcggggtgtttcggggactgcggccacaggcaggaaggcgctcctctcctgccccgccgacgcccggccagcccgcttcgccctgacctgtttcctcatgactgcccccggccctgctgccgacggacgtcgccccggcgtccggatttaacacggaaacccggatcggaggccgcgcggggaggaggagggcgacccggtcggtcctgcgaccctctcggcccggctcggcgcctcggcgggagccatgacctcgctgacccagcgcagctccggcctggtgcagcggcgcaccgaggcctcccgcaacgccgccgacaaggagcgggcggcgggcggcggcgccggcagcagcgaggacgacgcgcagagccgccgcgacgagcaggacgacgacgacaagggcgactccaaggaaacgcggctgaccctgatggaggaagtgctcctgctgggcctcaaggaccgcgagggttacacatcattttggaatgactgtatatcatctggattacgtggctgtatgttaattgaattagcattgagaggaaggttacaactagaggcttgtggaatgagacgtaaaagtctattaacaagaaaggtaatctgtaagtcagatgctccaacaggggatgttcttcttgatgaagctctgaagcatgttaaggaaactcagcctccagaaacggtccagaactggattgaattacttagtggtgagacatggaatccattaaaattgcattatcagttaagaaatgtacgggaacgattagctaaaaacctggtggaacatcccctcaccaataacaacattaagcagcgcctcatcaagaaagtacaggaagccgttcttgacaaatgggtgaatgaccctcaccgcatggacaggcgcttgctggccctcatttacctggctcatgcctcggacgtcctggagaatgcttttgctcctcttctggacgagcagtatgatttggctaccaagagagtgcggcagcttctcgacttagaccctgaagtggaatgtctgaaggccaacaccaatgaggttctgtgggcggtggtggcggcgttcaccaagtaactctgctcggggtgaaccattctcctttctctcaagtaaaccagtagtttttcttctgttgacttctggttttctgtaatttgtactttcccacactataattggcttctgttttacaaaatggtgggtggctttttcttttttgtacgtgtacaggattctgctggtacgagaggccttcctctttctgtttttaaaaaaagttttactgccatattggcattccattccctgttgccatcctcactgttacctgttttgggtttctggtctactttgactttcaaagtacctccagcctcctcatacgcacagcttttggatgacctcagcttgagtttctccatatgtgcatgtacatctagcattctgcctacagttcagacagaagtcacaaaaaggccttcaactcaccaaaggtaaatatctgtatctattaggacattttttacatagacttcagttgagatgtatacttagcaaaattatttttaaattgaaacagcacagtaaatacttaatataaaatgtcccttggattttgcttcccatgtaaatctattgtattattacacttgttataattttaactataaaggtccaattgtttcacagagccagtttgggatgggctgcattccatttatgctgtatatagtttgaattatatataaattaccccttcttctggccacccctgctcccatcttagtattttgcaagatctaatcagttgtacacctggtgcccctcgcttgcttcaatcatggttatttgatggcaaaatcgacctcttgtcgctgaaggagagagaaaagatgtgtgtctgattggtcctgggattttttgagctgtgccatttatggtactctttgcctatgcatcccctttttagattttttttaaattttatcttactgtttttataatttctattgggaagaggcttgtgaccagtaccaatcttgagtttctttttctgtccacaagtaaattaatatctgctctgaaatgtcatttatctactcacacattcttggggaaaaaaatcaaatgtcagtcctagcagatgttgcatgtaaattggtagcaagtaatgattacaacccagaggattaagaattttgtaacagaaagctctatgttttaattttttatatacaattaggataattagcattgtcagactataaacctttgctttttaaagtttatttttactatttctttatcactttattgtatcatcaccattggtttcataatgtaaatactatatgttgaacaaattaaatgtcaaaattttttattaccatagtccatgttaatagtggggctttcaggtgtttagagattttttttgttgttgttaacattcattgcaaaagtactagatggtgtataactctagagttgaattttaagggattccctaatatgtatactatctttttatctgaagtaataaataaacaatgatcttg

SEQ ID NO: 307492 - DNA, 2197 bp, Homo sapiens
cgtcagccggggccgccatattggaaaggcgccgccgccgcctccgccttggagctcggggtgtttcggggactgcggccacaggcaggaaggcgctcctctcctgccccgccgacgcccggccagcccgcttcgccctgacctgtttcctcatgactgcccccggccctgctgccgacggacgtcgccccggcgtccggatttaacacggaaacccggatcggaggccgcgcggggaggaggagggcgacccggtcggtcctgcgaccctctcggcccggctcggcgcctcggcgggagccatgacctcgctgacccagcgcagctccggcctggtgcagcggcgcaccgaggcctcccgcaacgccgccgacaaggagcgggcggcgggcggcggcgccggcagcagcgaggacgacgcgcagagccgccgcgacgagcaggacgacgacgacaagggcgactccaaggaaacgcggctgaccctgatggaggaagtgctcctgctgggcctcaaggaccgcgagggttacacatcattttggaatgactgtatatcatctggattacgtggctgtatgttaattgaattagcattgagaggaaggttacaactagaggcttgtggaatgagacgtaaaagtctattaacaagaaaggtaatctgtaagtcagatgctccaacaggggatgttcttcttgatgaagctctgaagcatgttaaggaaactcagcctccagaaacggtccagaactggattgaattacttagtggtgagacatggaatccattaaaattgcattatcagttaagaaatgtacgggaacgattagctaaaaacctggtggaaaagggtgtattgacaacagagaaacagaacttcctactttttgacatgacaacacatcccctcaccaataacaacattaagcagcgcctcatcaagaaagtacaggaagccgttcttgacaaatgggtgaatgaccctcaccgcatggacaggcgcttgctggccctcatttacctggctcatgcctcggacgtcctggagaatgcttttgctcctcttctggacgagcagtatgatttggctaccaagagagtgcggcagcttctcgacttagaccctgaagtggaatgtctgaaggccaacaccaatgaggttctgtgggcggtggtggcggcgttcaccaagtaactctgctcggggtgaaccattctcctttctctcaagtaaaccagtagtttttcttctgttgacttctggttttctgtaatttgtactttcccacactataattggcttctgttttacaaaatggtgggtggctttttcttttttgtacgtgtacaggattctgctggtacgagaggccttcctctttctgtttttaaaaaaagttttactgccatattggcattccattccctgttgccatcctcactgttacctgttttgggtttctggtctactttgactttcaaagtacctccagcctcctcatacgcacagcttttggatgacctcagcttgagtttctccatatgtgcatgtacatctagcattctgcctacagttcagacagaagtcacaaaaaggccttcaactcaccaaaggtaaatatctgtatctattaggacattttttacatagacttcagttgagatgtatacttagcaaaattatttttaaattgaaacagcacagtaaatacttaatataaaatgtcccttggattttgcttcccatgtaaatctattgtattattacacttgttataattttaactataaaggtccaattgtttcacagagccagtttgggatgggctgcattccatttatgctgtatatagtttgaattatatataaattaccccttcttctggccacccctgctcccatcttagtattttgcaagatctaatcagttgtacacctggtgcccctcgcttgcttcaatcatggttatttgatggcaaaatcgacctcttgtcgctgaaggagagagaaaagatgtgtgtctgattggtcctgggattttttgagctgtgccatttatggtactctttgcctatgcatcccctttttagattttttttaaattttatcttactgtttttataatttctattgggaagaggcttgtgaccagtaccaatagaaattataaaaacagtaagataaaaaaaaaaa

SEQ ID NO: 307493 - DNA, 1382 bp, Homo sapiens
acctcagtgatgtgatagttggtgggtggctttttcttttttgtacgtgtacaggattctgctggtacgagaggccttcctctttctgtttttaaaaaaagttttactgccatattggcattccattccctgttgccatcctcactgttacctgttttgggtttctggtctactttgactttcaaagtacctccagcctcctcatacgcacagcttttggatgacctcagcttgagtttctccatatgtgcatgtacatctagcattctgcctacagttcagacagaagtcacaaaaaggccttcaactcaccaaaggtaaatatctgtatctattaggacattttttacatagacttcagttgagatgtatacttagcaaaattatttttaaattgaaacagcacagtaaatacttaatataaaatgtcccttggattttgcttcccatgtaaatctattgtattattacacttgttataattttaactataaaggtccaattgtttcacagagccagtttgggatgggctgcattccatttatgctgtatatagtttgaattatatataaattaccccttcttctggccacccctgctcccatcttagtattttgcaagatctaatcagttgtacacctggtgcccctcgcttgcttcaatcatggttatttgatggcaaaatcgacctcttgtcgctgaaggagagagaaaagatgtgtgtctgattggtcctgggattttttgagctgtgccatttatggtactctttgcctatgcatcccctttttagattttttttaaattttatcttactgtttttataatttctattgggaagaggcttgtgaccagtaccaatcttgagtttctttttctgtccacaagtaaattaatatctgctctgaaatgtcatttatctactcacacattcttggggaaaaaaatcaaatgtcagtcctagcagatgttgcatgtaaattggtagcaagtaatgattacaacccagaggattaagaattttgtaacagaaagctctatgttttaattttttatatacaattaggataattagcattgtcagactataaacctttgctttttaaagtttatttttactatttctttatcactttattgtatcatcaccattggtttcataatgtaaatactatatgttgaacaaattaaatgtcaaaattttttattaccatagtccatgttaatagtggggctttcaggtgtttagagattttttttgttgttgttaacattcattgcaaaagtactagatggtgtataactctagagttgaattttaagggattccctaatatgtatactatctttttatctgaagtaataaataaacaatgatcttg

SEQ ID NO: 307494 - DNA, 2699 bp, Homo sapiens
aatgcaggctgtcggccgggtttacggatcgccttggagctcggggtgtttcggggactgcggccacaggcaggaaggcgctcctctcctgccccgccgacgcccggccagcccgcttcgccctgacctgtttcctcatgactgcccccggccctgctgccgacggacgtcgccccggcgtccggatttaacacggaaacccggatcggaggccgcgcggggaggaggagggcgacccggtcggtcctgcgaccctctcggcccggctcggcgcctcggcgggagccatgacctcgctgacccagcgcagctccggcctggtgcagcggcgcaccgaggcctcccgcaacgccgccgacaaggagcgggcggcgggcggcggcgccggcagcagcgaggacgacgcgcagagccgccgcgacgagcaggacgacgacgacaagggcgactccaaggaaacgcggctgaccctgatggaggaagtgctcctgctgggcctcaaggaccgcgagggttacacatcattttggaatgactgtatatcatctggattacgtggctgtatgttaattgaattagcattgagaggaaggttacaactagaggcttgtggaatgagacgtaaaagtctattaacaagaaaggtaatctgtaagtcagatgctccaacaggggatgttcttcttgatgaagctctgaagcatgttaaggaaactcagcctccagaaacggtccagaactggattgaattacttagtggtgagacatggaatccattaaaattgcattatcagttaagaaatgtacgggaacgattagctaaaaacctggtggaaaagggtgtattgacaacagagaaacagaacttcctactttttgacatgacaacacatcccctcaccaataacaacattaagcagcgcctcatcaagaaagtacaggaagccgttcttgacaaatgggtgaatgaccctcaccgcatggacaggcgcttgctggccctcatttacctggctcatgcctcggacgtcctggagaatgcttttgctcctcttctggacgagcagtatgatttggctaccaagagagtgcggcagcttctcgacttagaccctgaagtggaatgtctgaaggccaacaccaatgaggttctgtgggcggtggtggcggcgttcaccaagtaactctgctcggggtgaaccattctcctttctctcaagtaaaccagtagtttttcttctgttgacttctggttttctgtaatttgtactttcccacactataattggcttctgttttacaaaatggtgggtggctttttcttttttgtacgtgtacaggattctgctggtacgagaggccttcctctttctgtttttaaaaaaagttttactgccatattggcattccattccctgttgccatcctcactgttacctgttttgggtttctggtctactttgactttcaaagtacctccagcctcctcatacgcacagcttttggatgacctcagcttgagtttctccatatgtgcatgtacatctagcattctgcctacagttcagacagaagtcacaaaaaggccttcaactcaccaaaggtaaatatctgtatctattaggacattttttacatagacttcagttgagatgtatacttagcaaaattatttttaaattgaaacagcacagtaaatacttaatataaaatgtcccttggattttgcttcccatgtaaatctattgtattattacacttgttataattttaactataaaggtccaattgtttcacagagccagtttgggatgggctgcattccatttatgctgtatatagtttgaattatatataaattaccccttcttctggccacccctgctcccatcttagtattttgcaagatctaatcagttgtacacctggtgcccctcgcttgcttcaatcatggttatttgatggcaaaatcgacctcttgtcgctgaaggagagagaaaagatgtgtgtctgattggtcctgggattttttgagctgtgccatttatggtactctttgcctatgcatcccctttttagattttttttaaattttatcttactgtttttataatttctattgggaagaggcttgtgaccagtaccaatcttgagtttctttttctgtccacaagtaaattaatatctgctctgaaatgtcatttatctactcacacattcttggggaaaaaaatcaaatgtcagtcctagcagatgttgcatgtaaattggtagcaagtaatgattacaacccagaggattaagaattttgtaacagaaagctctatgttttaattttttatatacaattaggataattagcattgtcagactataaacctttgctttttaaagtttatttttactatttctttatcactttattgtatcatcaccattggtttcataatgtaaatactatatgttgaacaaattaaatgtcaaaattttttattaccatagtccatgttaatagtggggctttcaggtgtttagagattttttttgttgttgttaacattcattgcaaaagtactagatggtgtataactctagagttgaattttaagggattccctaatatgtatactatctttttatctgaagtaataaataaacaatgatcttgaaagtgcctgaatcagagcaagcaaaaaaat

SEQ ID NO: 307495 - DNA, 2828 bp, Homo sapiens
cgtcagccggggccgccatattggaaaggcgccgccgccgcctccgccttggagctcggggtgtttcggggactgcggccacaggcaggaaggcgctcctctcctgccccgccgacgcccggccagcccgcttcgccctgacctgtttcctcatgactgcccccggccctgctgccgacggacgtcgccccggcgtccggatttaacacggaaacccggatcggaggccgcgcggggaggaggagggcgacccggtcggtcctgcgaccctctcggcccggctcggcgcctcggcgggagccatgacctcgctgacccagcgcagctccggcctggtgcagcggcgcaccgaggcctcccgcaacgccgccgacaaggagcgggcggcgggcggcggcgccggcagcagcgaggacgacgcgcagagccgccgcgacgagcaggacgacgacgacaagggcgactccaaggaaacgcggctgaccctgatggaggaagtgctcctgctgggcctcaaggaccgcgagggttacacatcattttggaatgactgtatatcatctggattacgtggctgtatgttaattgaattagcattgagaggaaggttacaactagaggcttgtggaatgagacgtaaaagtctattaacaagaaaggtaatctgtaagtcagatgctccaacaggggatgttcttcttgatgaagctctgaagcatgttaaggaaactcagcctccagaaacggtccagaactggattgaattacttagtggtgagacatggaatccattaaaattgcattatcagttaagaaatgtacgggaacgattagctaaaaacctggtggaaaagggtgtattgacaacagagaaacagaacttcctactttttgacatgacaacacatcccctcaccaataacaacattaagcagcgcctcatcaagaaagtacaggaagccgttcttgacaaatgggtgaatgaccctcaccgcatggacaggcgcttgctggccctcatttacctggctcatgcctcggacgtcctggagaatgcttttgctcctcttctggacgagcagtatgatttggctaccaagagagtgcggcagcttctcgacttagaccctgaagtggaatgtctgaaggccaacaccaatgaggttctgtgggcggtggtggcggcgttcaccaagtaactctgctcggggtgaaccattctcctttctctcaagtaaaccagtagtttttcttctgttgacttctggttttctgtaatttgtactttcccacactataattggcttctgttttacaaaatggtgggtggctttttcttttttgtacgtgtacaggattctgctggtacgagaggccttcctctttctgtttttaaaaaaagttttactgccatattggcattccattccctgttgccatcctcactgttacctgttttgggtttctggtctactttgactttcaaagtacctccagcctcctcatacgcacagcttttggatgacctcagcttgagtttctccatatgtgcatgtacatctagcattctgcctacagttcagacagaagtcacaaaaaggccttcaactcaccaaaggtaaatatctgtatctattaggacattttttacatagacttcagttgagatgtatacttagcaaaattatttttaaattgaaacagcacagtaaatacttaatataaaatgtcccttggattttgcttcccatgtaaatctattgtattattacacttgttataattttaactataaaggtccaattgtttcacagagccagtttgggatgggctgcattccatttatgctgtatatagtttgaattatatataaattaccccttcttctggccacccctgctcccatcttagtattttgcaagatctaatcagttgtacacctggtgcccctcgcttgcttcaatcatggttatttgatggcaaaatcgacctcttgtcgctgaaggagagagaaaagatgtgtgtctgattggtcctgggattttttgagctgtgccatttatggtactctttgcctatgcatcccctttttagattttttttaaattttatcttactgtttttataatttctattgggaagaggcttgtgaccagtaccaatcttgagtttctttttctgtccacaagtaaattaatatctgctctgaaatgtcatttatctactcacacattcttggggaaaaaaatcaaatgtcagtcctagcagatgttgcatgtaaattggtagcaagtaatgattacaacccagaggattaagaattttgtaacagaaagctctatgttttaattttttatatacaattaggataattagcattgtcagactataaacctttgctttttaaagtttatttttactatttctttatcactttattgtatcatcaccattggtttcataatgtaaatactatatgttgaacaaattaaatgtcaaaattttttattaccatagtccatgttaatagtggggctttcaggtgtttagagattttttttgttgttgttaacattcattgcaaaagtactagatggtgtataactctagagttgaattttaagggattccctaatatgtatactatctttttatctgaagtaataaataaacaatgatcttggagaagaaaaatgagaggaaaacttgggggggggccgggcaccaatttccccctatagtggatgggaaaaacaattcagtgcccgacgtttaacaccgttgtggcttggaaaacccctgctgtcccccaactttatccgccggga

SEQ ID NO: 307496 - DNA, 2551 bp, Homo sapiens
cgtcagccggggccgccatattggaaaggcgccgccgccgcctccgccttggagctcggggtgtttcggggactgcggccacaggcaggaaggcgctcctctcctgccccgccgacgcccggccagcccgcttcgccctgacctgtttcctcatgactgcccccggccctgctgccgacggacgtcgccccggcgtccggatttaacacggaaacccggatcggaggccgcgcggggaggaggagggcgacccggtcggtcctgcgaccctctcggcccggctcggcgcctcggcgggagccatgacctcgctgacccagcgcagctccggcctggtgcagcggcgcaccgaggcctcccgcaacgccgccgacaaggagcgggcggcgggcggcggcgccggcagcagcgaggacgacgcgcagagccgccgcgacgagcaggacgacgacgacaagggcgactccaaggaaacgcggctgaccctgatggaggaagtgctcctgctgggcctcaaggaccgcgaggtaatctgtaagtcagatgctccaacaggggatgttcttcttgatgaagctctgaagcatgttaaggaaactcagcctccagaaacggtccagaactggattgaattacttagtggtgagacatggaatccattaaaattgcattatcagttaagaaatgtacgggaacgattagctaaaaacctggtggaaaagggtgtattgacaacagagaaacagaacttcctactttttgacatgacaacacatcccctcaccaataacaacattaagcagcgcctcatcaagaaagtacaggaagccgttcttgacaaatgggtgaatgaccctcaccgcatggacaggcgcttgctggccctcatttacctggctcatgcctcggacgtcctggagaatgcttttgctcctcttctggacgagcagtatgatttggctaccaagagagtgcggcagcttctcgacttagaccctgaagtggaatgtctgaaggccaacaccaatgaggttctgtgggcggtggtggcggcgttcaccaagtaactctgctcggggtgaaccattctcctttctctcaagtaaaccagtagtttttcttctgttgacttctggttttctgtaatttgtactttcccacactataattggcttctgttttacaaaatggtgggtggctttttcttttttgtacgtgtacaggattctgctggtacgagaggccttcctctttctgtttttaaaaaaagttttactgccatattggcattccattccctgttgccatcctcactgttacctgttttgggtttctggtctactttgactttcaaagtacctccagcctcctcatacgcacagcttttggatgacctcagcttgagtttctccatatgtgcatgtacatctagcattctgcctacagttcagacagaagtcacaaaaaggccttcaactcaccaaaggtaaatatctgtatctattaggacattttttacatagacttcagttgagatgtatacttagcaaaattatttttaaattgaaacagcacagtaaatacttaatataaaatgtcccttggattttgcttcccatgtaaatctattgtattattacacttgttataattttaactataaaggtccaattgtttcacagagccagtttgggatgggctgcattccatttatgctgtatatagtttgaattatatataaattaccccttcttctggccacccctgctcccatcttagtattttgcaagatctaatcagttgtacacctggtgcccctcgcttgcttcaatcatggttatttgatggcaaaatcgacctcttgtcgctgaaggagagagaaaagatgtgtgtctgattggtcctgggattttttgagctgtgccatttatggtactctttgcctatgcatcccctttttagattttttttaaattttatcttactgtttttataatttctattgggaagaggcttgtgaccagtaccaatcttgagtttctttttctgtccacaagtaaattaatatctgctctgaaatgtcatttatctactcacacattcttggggaaaaaaatcaaatgtcagtcctagcagatgttgcatgtaaattggtagcaagtaatgattacaacccagaggattaagaattttgtaacagaaagctctatgttttaattttttatatacaattaggataattagcattgtcagactataaacctttgctttttaaagtttatttttactatttctttatcactttattgtatcatcaccattggtttcataatgtaaatactatatgttgaacaaattaaatgtcaaaattttttattaccatagtccatgttaatagtggggctttcaggtgtttagagattttttttgttgttgttaacattcattgcaaaagtactagatggtgtataactctagagttgaattttaagggattccctaatatgtatactatctttttatctgaagtaataaataaacaatgatcttg

SEQ ID NO: 307497 - DNA, 686 bp, Homo sapiens
gaagcttctgcacatgtagttcctagagctgctgcttattaaaatgtcaacatcttcatcttctagctgggacaacctcttagagtctctctctctcagcacagtatggaattggatacaagcaagttttttgggagagactagtgcacctcagcaaacaagtttgggactattagataatcttgctccagctgtgcaaatcatcttgaggatttctttcttgattttattgggaataggaatatatgccttatggaaacgaagtattcagtcaattcagaaaacattgttgtttgtaatcacactctacaaactttacaagaagggctcacatatttttgaggctttgctagccaacccagaaggaagtggtctccgaattcaagacaataataatcttttcctgtccttgggtctgcaagagaaaattttgaaaaaacttaagacagtggaaaacaaaatgaagaacctagaagggataatcgttgctcaaaaacctgccacgaagagggattgctcctctgagccctactgcagctgctctgactgccagagtcccttgtccacatcagggtttacttcccccatttgaaatgtgatggactccaatcttttccaggaaagcactgtttccctcatgtgtgcagtggtgtatcaataaagatagagaacgctattgaaattac

SEQ ID NO: 307498 - DNA, 565 bp, Homo sapiens
  misc_feature (44)..(44): n is a, c, g, or t
agcaccccactacgcccaaacaatcaaaaatacccacacttaantagagactctcgttctgtcaccaaggctggagcacaacatcagctcactgcaacctctgcctcccaggttcaagtgattctcctgcttcagcctcccaagtagctgggactacagaaaacattgttgtttgtaatcacactctacaaactttacaagaagggctcacatatttttgaggctttgctagccaacccagaaggaagtggtctccgaattcaagacaataataatcttttcctgtccttgggtctgcaagagaaaattttgaaaaaacttaagacagtggaaaacaaaatgaagaacctagaagggataatcgttgctcaaaaacctgccacgaagagggattgctcctctgagccctactgcagctgctctgactgccagagtcccttgtccacatcagggtttacttcccccatttgaaatgtgatggactccaatcttttccaggaaagcactgtttccctcatgtgtgcagtggtgtatcaataaagatagagaacgctattgaaattac

SEQ ID NO: 307499 - DNA, 1559 bp, Homo sapiens
gaagcttctgcacatgtagttcctagagctgctgcttattaaaatgtcaacatcttcatcttctagctgggacaacctcttagagtctctctctctcagcacagtatggaattggatacaagcaagttttttgggagagactagtgcacctcagcaaacaagtttgggactattagataatcttgctccagctgtgcaaatcatcttgaggatttctttcttgattttattgggaataggaatatatgccttatggaaacgaagtattcagtcaattcagaaaacattgttgtttgtaatcacactctacaaactttacaagaagggctcacatatttttgaggctttgctagccaacccagaaggaagtggtctccgaattcaagacaataataatcttttcctgtccttgggtctgcaagagaaaattttgaaaaaacttaagacagtggaaaacaaaatgaagaacctagaagggataatcgttgctcaaaaacctgccacgaagagggattgctcctctgagccctactgcagctgctctgactgccagagtcccttgtccacatcagggtttacttcccccatttgaaatgtgatggactccaatcttttccaggaaagcactgtttccctcatgtgtgcagtggtgtatcaataaagatagagaacgctattgaaattacaaaaaaaaaaaaaaaaaaaaaaaaaaaaaaaaaaaaaagggggggcggcgcgcccaaagattatccccccaaggggggccccaagtttatcgagtgctaaccccacgatttgctcgggtacacaagggggccccaaaagaggaggagccgaatataaagacgaagaacgcggggcagcaaggatataaaacaaacgctcggaagcgggaaaaaaagtcggcaaccgggggcaccattgggggcaaggggagaaccacataaaccacgagaggggggggaaccaaatgtggggcacaaacaacgctacccccacaagaagatcttaaacagcccccgaggggacaacataaaacacaccctcacaagcgataaacaggggtgtgcacacacaacaacgcgcgccaatagccgcacgcgcctaagcaaaaacagttggagcaccacagcaacaaagcaacaatctgaaggcagaaacatcttatccaccccgcggggaagccagcaggacaaaaacaatccccacacagagcagcccagaaagcgacaaacacaagccacctcacccaaacgaaaggaaagaagagaagaacagaagaagagagaaaggacaataacgatgccggacaggtgaaaaaaaggaaacagaaaacaacgagagagagagctagacagaggaacaaaggcggaaaagaagaagagaacggaaaaccaaaacaacaaacaggacagccaaagagacagaaacaacagagcgcgaaggaaacaacaagcaaacaaacagaagagaacacagcaagaaaacaagaaagcaggagaacagcagaaggacaaaaaaaaggaaggaaacacgcgaaaaaacagacgcagaacaaa

SEQ ID NO: 307500 - DNA, 2819 bp, Homo sapiens
agcccgcggagctgagcggcggcggcggcggcggcaggagcccgggaggcggaggcgggaggcggcggcggcgcgcggagacgcagcagcggcagcggcagcatgtcggccggcggagcgtcagtcccgccgcccccgaaccccgccgtgtccttcccgccgccccgggtcaccctgcccgccggccccgacatcctgcggacctactcgggcgccttcgtctgcctggagattctgttcgggggtcttgtctggattttggttgcctcctccaatgttcctctacctctactacaaggatgggtcatgtttgtgtccgtgacagcgtttttcttttcgctcctctttctgggcatgttcctctctggcatggtggctcaaattgatgctaactggaacttcctggattttgcctaccattttacagtatttgtcttctattttggagcctttttattggaagcagcagccacatccctgcatgatttgcattgcaatacaaccataaccgggcagccactcctgagtgataaccagtataacataaacgtagcagcctcaatttttgcctttatgacgacagcttgttatggttgcagtttgggtctggctttacgaagatggcgaccgtaacactccttagaaactggcagtcgtatgttagtttcacttgtctactttatatgtctgatcaatttggataccattttgtccagatgcaaaaacattccaaaagtaatgtgtttagtagagagagactctaagctcaagttctggtttatttcatggatggaatgttaattttattatgatattaaagaaatggccttttattttacatctctcccctttttccctttccccctttattttcctccttttctttctgaaagtttccttttatgtccataaaatacaaatatattgttcataaaaaattagtatcccttttgtttggttgctgagtcacctgaaccttaattttaattggtaattacagcccctaaaaaaaacacatttcaaataggcttcccactaaactctatattttagtgtaaaccaggaattggcacactttttttagaatgggccagatggtaaatatttatgcttcacggtccatacagtctctgtcacaactattcagttctgctagtatagcgtgaaagcagctatacacaatacagaaatgaatgagtgtggttatgttctaataaaacttatttataaaaacaaggggaggctgggtttagcctgtgggccatagtttgtcaaccactggtgtaaaaccttagttatatatgatctgcattttcttgaactgatcattgaaaacttataaacctaacagaaaagccacataatatttagtgtcattatgcaataatcacattgcctttgtgttaatagtcaaatacttacctttggagaatacttacctttggaggaatgtataaaatttctcaggcagagtcctggatataggaaaaagtaatttatgaagtaaacttcagttgcttaatcaaactaatgatagtctaacaactgagcaagatcctcatctgagagtgcttaaaatgggatccccagagaccattaaccaatactggaactggtatctagctactgatgtcttactttgagtttatttatgcttcagaatacagttgtttgccctgtgcatgaatatacccatatttgtgtgtggatatgtgaagcttttccaaatagagctctcagaagaattaagtttttacttctaattattttgcattactttgagttaaatttgaatagagtattaaatataaagttgtagattcttatgtgtttttgtattagcccagacatctgtaatgtttttgcactggtgacagacaaaatctgttttaaaatcatatccagcacaaaaactatttctggctgaatagcacagaaaagtattttaacctacctgtagagatcctcgtcatggaaaggtgccaaactgttttgaatggaaggacaagtaagagtgaggccacagttcccaccacacgagggcttttgtattgttctactttttcagccctttactttctggctgaagcatccccttggagtgccatgtataagttgggctattagagttcatggaacatagaacaaccatgaatgagtggcatgatccgtgcttaatgatcaagtgttacttatctaataatcctctagaaagaaccctgttagatcttggtttgtgataaaaatataaagacagaagacatgaggaaaaacaaaaggtttgaggaaatcaggcatatgactttatacttaacatcagatcttttctataatatcctactactttggttttcctagctccataccacacacctaaacctgtattatgaattacatattacaaagtcataaatgtgccatatggatatacagtacattctagttggaatcgtttactctgctagaatttaggtgtgagattttttgtttcccaggtatagcaggcttatgtttggtggcattaaattggtttctttaaaatgctttggtggcacttttgtaaacagattgcttctagattgttacaaaccaagcctaagacacatctgtgaatacttagatttgtagcttaatcacattctagacttgtgagttgaatgacaaagcagttgaacaaaaattatggcatttaagaatttaacatgtcttagctgtaaaaatgagaaagtgttggttggttttaaaatctggtaactccatgatgaaaagaaatttattttatacgtgttatgtctctaataaagtattcatttgataaa

SEQ ID NO: 307501 - DNA, 932 bp, Homo sapiens
agcccgcggagctgagcggcggcggcggcggcggcaggagcccgggaggcggaggcgggaggcggcggcggcgcgcggagacgcagcagcggcagcggcagcatgtcggccggcggagcgtcagtcccgccgcccccgaaccccgccgtgtccttcccgccgccccgggtcaccctgcccgccggccccgacatcctgcggacctactcgggcgccttcgtctgcctggagattctgttcgggggtcttgtctggattttggttgcctcctccaatgttcctctacctctactacaaggatgggtcatgtttgtgtccgtgacagcgtttttcttttcgctcctctttctgggcatgttcctctctggcatggtggctcaaattgatgctaactggaacttcctggattttgcctaccattttacagtatttgtcttctattttggagcctttttattggaagcagcagccacatccctgcatgatttgcattgcaatacaaccataaccgggcagccactcctgagtgataaccagtataacataaacgtagcagcctcaatttttgcctttatgacgacagcttgttatggttgcagtttgggtctggctttacgaagatggcgaccgtaacactccttagaaactggcagtcgtatgttagtttcacttgtctactttatatgtctgatcaatttggataccattttgtccagatgcaaaaacattccaaaagtaatgtgtttagtagagagagactctaagctcaagttctggtttatttcatggatggaatgttaattttattatgatattaaagaaatggccttttattttacatctctcccctttttccctttccccctttattttcctccttttctttctgaaagtttccttttatgtccataaaatacaaatatattgttcat

SEQ ID NO: 307502 - DNA, 598 bp, Homo sapiens
agcccgcggagctgagcggcggcggcggcggcggcaggagcccgggaggcggaggcgggaggcggcggcggcgcgcggagacgcagcagcggcagcggcagcatgtcggccggcggagcgtcagtcccgccgcccccgaaccccgccgtgtccttcccgccgccccgggtcaccctgcccgccggccccgacatcctgcggacctactcgggcgccttcgtctgcctggagattctgttcgggggtcttgtctggattttggttgcctcctccaatgttcctctacctctactacaaggatgggtcatgtttgtgtccgtgacagcgtttttcttttcgctcctctttctgggcatgttcctctctggcatggtggctcaaattgatgctaactggaacttcctggattttgcctaccattttacagtatttgtcttctattttggagcctttttattggaagcagcagccacatccctgcatgatttgcattgcaatacaaccataaccgggcagccactcctgagtgataaccagtataacataaacgtagcagcctcagtaagtattcatattcaatgagtaccattcaccagca

SEQ ID NO: 307503 - DNA, 2749 bp, Homo sapiens
cgagctcgggcctttatttaatagtatgtaagtgactgtggagataattaggatatctagatactgaaatgcaatgtacagactgtgagttctgtggtgacagaaaccaagtgtaacctgtttaccatttgattcccagcacctggcatagtgcctgaaatgtactgttcgggggtcttgtctggattttggttgcctcctccaatgttcctctacctctactacaaggatgggtcatgtttgtgtccgtgacagcgtttttcttttcgctcctctttctgggcatgttcctctctggcatggtggctcaaattgatgctaactggaacttcctggattttgcctaccattttacagtatttgtcttctattttggagcctttttattggaagcagcagccacatccctgcatgatttgcattgcaatacaaccataaccgggcagccactcctgagtgataaccagtataacataaacgtagcagcctcaatttttgcctttatgacgacagcttgttatggttgcagtttgggtctggctttacgaagatggcgaccgtaacactccttagaaactggcagtcgtatgttagtttcacttgtctactttatatgtctgatcaatttggataccattttgtccagatgcaaaaacattccaaaagtaatgtgtttagtagagagagactctaagctcaagttctggtttatttcatggatggaatgttaattttattatgatattaaagaaatggccttttattttacatctctcccctttttccctttccccctttattttcctccttttctttctgaaagtttccttttatgtccataaaatacaaatatattgttcataaaaaattagtatcccttttgtttggttgctgagtcacctgaaccttaattttaattggtaattacagcccctaaaaaaaacacatttcaaataggcttcccactaaactctatattttagtgtaaaccaggaattggcacactttttttagaatgggccagatggtaaatatttatgcttcacggtccatacagtctctgtcacaactattcagttctgctagtatagcgtgaaagcagctatacacaatacagaaatgaatgagtgtggttatgttctaataaaacttatttataaaaacaaggggaggctgggtttagcctgtgggccatagtttgtcaaccactggtgtaaaaccttagttatatatgatctgcattttcttgaactgatcattgaaaacttataaacctaacagaaaagccacataatatttagtgtcattatgcaataatcacattgcctttgtgttaatagtcaaatacttacctttggagaatacttacctttggaggaatgtataaaatttctcaggcagagtcctggatataggaaaaagtaatttatgaagtaaacttcagttgcttaatcaaactaatgatagtctaacaactgagcaagatcctcatctgagagtgcttaaaatgggatccccagagaccattaaccaatactggaactggtatctagctactgatgtcttactttgagtttatttatgcttcagaatacagttgtttgccctgtgcatgaatatacccatatttgtgtgtggatatgtgaagcttttccaaatagagctctcagaagaattaagtttttacttctaattattttgcattactttgagttaaatttgaatagagtattaaatataaagttgtagattcttatgtgtttttgtattagcccagacatctgtaatgtttttgcactggtgacagacaaaatctgttttaaaatcatatccagcacaaaaactatttctggctgaatagcacagaaaagtattttaacctacctgtagagatcctcgtcatggaaaggtgccaaactgttttgaatggaaggacaagtaagagtgaggccacagttcccaccacacgagggcttttgtattgttctactttttcagccctttactttctggctgaagcatccccttggagtgccatgtataagttgggctattagagttcatggaacatagaacaaccatgaatgagtggcatgatccgtgcttaatgatcaagtgttacttatctaataatcctctagaaagaaccctgttagatcttggtttgtgataaaaatataaagacagaagacatgaggaaaaacaaaaggtttgaggaaatcaggcatatgactttatacttaacatcagatcttttctataatatcctactactttggttttcctagctccataccacacacctaaacctgtattatgaattacatattacaaagtcataaatgtgccatatggatatacagtacattctagttggaatcgtttactctgctagaatttaggtgtgagattttttgtttcccaggtatagcaggcttatgtttggtggcattaaattggtttctttaaaatgctttggtggcacttttgtaaacagattgcttctagattgttacaaaccaagcctaagacacatctgtgaatacttagatttgtagcttaatcacattctagacttgtgagttgaatgacaaagcagttgaacaaaaattatggcatttaagaatttaacatgtcttagctgtaaaaatgagaaagtgttggttggttttaaaatctggtaactccatgatgaaaagaaatttattttatacgtgttatgtctctaataaagtattcatttgataaa

SEQ ID NO: 307504 - DNA, 1106 bp, Homo sapiens
aagctctccccaggtttgtactcgctaattattgagcatatacttattaggaaggtagataacttgagagattccagtagtatgtgatactatacaagtggtaggtattcttatgtgtttttgtattagcccagacatctgtaatgtttttgcactggtgacagacaaaatctgttttaaaatcatatccagcacaaaaactatttctggctgaatagcacagaaaagtattttaacctacctgtagagatcctcgtcatggaaaggtgccaaactgttttgaatggaaggacaagtaagagtgaggccacagttcccaccacacgagggcttttgtattgttctactttttcagccctttactttctggctgaagcatccccttggagtgccatgtataagttgggctattagagttcatggaacatagaacaaccatgaatgagtggcatgatccgtgcttaatgatcaagtgttacttatctaataatcctctagaaagaaccctgttagatcttggtttgtgataaaaatataaagacagaagacatgaggaaaaacaaaaggtttgaggaaatcaggcatatgactttatacttaacatcagatcttttctataatatcctactactttggttttcctagctccataccacacacctaaacctgtattatgaattacatattacaaagtcataaatgtgccatatggatatacagtacattctagttggaatcgtttactctgctagaatttaggtgtgagattttttgtttcccaggtatagcaggcttatgtttggtggcattaaattggtttctttaaaatgctttggtggcacttttgtaaacagattgcttctagattgttacaaaccaagcctaagacacatctgtgaatacttagatttgtagcttaatcacattctagacttgtgagttgaatgacaaagcagttgaacaaaaattatggcatttaagaatttaacatgtcttagctgtaaaaatgagaaagtgttggttggttttaaaatctggtaactccatgatgaaaagaaatttattttatacgtgttatgtctctaataaagtattcatttgataaa

SEQ ID NO: 307505 - DNA, 2765 bp, Homo sapiens
agcccgcggagctgagcggcggcggcggcggcggcaggagcccgggaggcggaggcgggaggcggcggcggcgcgcggagacgcagcagcggcagcggcagcatgtcggccggcggagcgtcagtcccgccgcccccgaaccccgccgtgtccttcccgccgccccgggtcaccctgcccgccggccccgacatcctgcggacctactcgggcgccttcgtctgcctggagattctgttcgggggtcttgtctggattttggttgcctcctccaatgttcctctacctctactacaaggatgggtcatgtttgtgtccgtgacagcgtttttcttttcgctcctctttctgggcatgttcctctctggcatggtggctcaaattgatgctaactggaacttcctggattttgcctaccattttacagtatttgtcttctattttggagcctttttattggaagcagcagccacatccctgcatgatttgcattgcaatacaaccataaccgggcagccactcctgagtgataaccagtataacataaacgtagcagcctcaatttttgcctttatgacgacagcttgttatggttgcagtttgggtctggctttacgaagatggcgaccgtaacactccttagaaactggcagtcgtatgttagtttcacttgtctactttatatgtctgatcaatttggataccattttgtccagatgcaaaaacattccaaaagtaatgtgtttagtagagagagactctaagctcaagttctggtttatttcatggatggaatgttaattttattatgatattaaagaaatggccttttattttacatctctcccctttttccctttccccctttattttcctccttttctttctgaaagtttccttttatgtccataaaatacaaatatattgttcataaaaaattagtatcccttttgtttggttgctgagtcacctgaaccttaattttaattggtaattacagcccctaaaaaaaacacatttcaaataggcttcccactaaactctatattttagtgtaaaccaggaattggcacactttttttagaatgggccagatggtaaatatttatgcttcacggtccatacagtctctgtcacaactattcagttctgctagtatagcgtgaaagcagctatacacaatacagaaatgaatgagtgtggttatgttctaataaaacttatttataaaaacaaggggaggctgggtttagcctgtgggccatagtttgtcaaccactggtgtaaaaccttagttatatatgatctgcattttcttgaactgatcattgaaaacttataaacctaacagaaaagccacataatatttagtgtcattatgcaataatcacattgcctttgtgttaatagtcaaatacttacctttggagaatacttacctttggaggaatgtataaaatttctcaggcagagtcctggatataggaaaaagtaatttatgaagtaaacttcagttgcttaatcaaactaatgatagtctaacaactgagcaagatcctcatctgagagtgcttaaaatgggatccccagagaccattaaccaatactggaactggtatctagctactgatgtcttactttgagtttatttatgcttcagaatacagttgtttgccctgtgcatgaatatacccatatttgtgtgtggatatgtgaagcttttccaaatagagctctcagaagaattaagtttttacttctaattattttgcattactttgagttaaatttgaatagagtattaaatataaagttgtagattcttatgtgtttttgtattagcccagacatctgtaatgtttttgcactggtgacagacaaaatctgttttaaaatcatatccagcacaaaaactatttctggctgaatagcacagaaaagtattttaacctacctgtagagatcctcgtcatggaaaggtgccaaactgttttgaatggaaggacaagtaagagtgaggccacagttcccaccacacgagggcttttgtattgttctactttttcagccctttactttctggctgaagcatccccttggagtgccatgtataagttgggctattagagttcatggaacatagaacaaccatgaatgagtggcatgatccgtgcttaatgatcaagtgttacttatctaataatcctctagaaagaaccctgttagatcttggtttgtgataaaaatataaagacagaagacatgaggaaaaacaaaaggtttgaggaaatcaggcatatgactttatacttaacatcagatcttttctataatatcctactactttggttttcctagctccataccacacacctaaacctgtattatgaattacatattacaaagtcataaatgtgccatatggatatacagtacattctagttggaatcgtttactctgctagaatttaggtgtgagattttttgtttcccaggtatagcaggcttatgtttggtggcattaaattggtttctttaaacctaagacacatctgtgaatacttagatttgtagcttaatcacattctagacttgtgagttgaatgacaaagcagttgaacaaaaattatggcatttaagaatttaacatgtcttagctgtaaaaatgagaaagtgttggttggttttaaaatctggtaactccatgatgaaaagaaatttattttatacgtgttatgtctctaataaagtattcatttgataaa

SEQ ID NO: 307506 - DNA, 1095 bp, Homo sapiens
tatttttagtagagacggggtttcaccatgttggccaggctggtctcgaactcctaacgtcaagtgatccacccgcctcagcctcccaaactgttggattacaggcgtgagctgccacgcccaaccacttttgttgttttagaacaaaaggtatcattcatcatgtagccgggcagatatctcaatatccaaagctgacattcgtgcaggtaccatagagacaagcgacatagcttattttgggctgcctcgtatgtgccagatttgtagaaagctgctttgtgcagggagatcccaggtgcactcaacacgttctccatgtatataagacctcccgaaagccttgggtggtttatctgttaccactttgaaaggtgggttaggacttcttcagcctgatctggccttgtgtcccaccagccacaggacacactgtgccttttccctaagggctgtcctttggagtttgccagaggttctgaaacaagaacaggatttctcatcatgtatgctgtatttcatcaactctcaggagccatgaaagctgcacagttactttatataccacgaggcaatcaaacggtacagggccaccacttcgaatttttcttacgctcttgttgaaagagcttttctaaataagaattcgatttttgtacacacacgtaaaaggaaaataggaccaagatgagttggttatgaccatgtcagttttgtcaccgtggccacctggccagtggtgactgagacatcactgaaattgcctcctaatttccaagacgttaaaggtgtcttagaatcgattagacacagcatttaccttacacattgttaaattttcagctttacctttaaatatcattttggggagattatttatcccaggcctgcatcccaagtcatttaaatttttacaaaggacactaggactttctgaagacccagcctatgcctgagacccatggggtcttggaggcggaggatataacactgaagaccagcgacaggctaccctctgagtgtggtgtgtgcacaagcctttcagggggcacattcacaagtacctgttgtgtccccttcagatgcaaaaaaaaa

SEQ ID NO: 307507 - DNA, 5037 bp, Homo sapiens
caggactggagggcttgaggaatgtggtggtccctctcttcgttgtttctgcccactgaggttgtgctttctcagggatatgcactctgcacttccattcctgcagtgaaattaactcgagcttggcagctcgagaggagaatgtggccactttccgaggctcagagtatctgtgctacgacctgtctcagaacccgatccagagcagcagtgatgaaatcaccctctcctttaagacctggcagcgtaacggcctcatcctgcacacgggcaagtcggctgactatgtcaacctggctctgaaggatggtgcggtctccttggtcattaacctggggtccggggcctttgaggccattgtggagccagtgaatggaaaattcaacgacaacgcctggcatgatgtcaaagtgacacgcaacctccggcaggtgacaatctctgtggatggcattcttaccacgacgggctacactcaagaggactataccatgctgggctcggacgacttcttctatgtaggaggaagcccaagtaccgctgacttgcctggctcccctgtcagcaacaacttcatgggctgccttaaagaggttgtttataagaataatgacatccgtctggagctgtctcgcctggcccggattgcggacaccaagatgaaaatctatggcgaagttgtgtttaagtgtgagaatgtggccacactggaccccatcaactttgagaccccagaggcttacatcagcttgcccaagtggaacactaaacgtatgggctccatctcctttgacttccgcaccacagagcccaatggcctgatcctcttcactcatggaaagccccaagagaggaaggatgctcggagccagaagaatacaaaagtagacttctttgccgtggaactcctcgatggcaacctgtacttgctgcttgacatgggctctggcaccatcaaagtgaaagccactcagaagaaagccaatgatggggaatggtaccatgtggacattcagcgagatggcagatcaggtactatatcagtgaacagcaggcgcacgccattcaccgccagtggggagagcgagatcctggacctggaaggagacatgtacctgggagggctgccggagaaccgtgctggccttattctccccaccgagctgtggactgccatgctcaactatggctacgtgggctgcatccgcgacctattcattgatgggcgcagcaagaacattcgacagctggcagagatgcagaatgctgcgggtgtcaagtcctcctgttcacggatgagtgccaagcagtgtgacagctacccctgcaagaataatgctgtgtgcaaggacggctggaaccgcttcatctgcgactgcaccggcaccggatactggggaagaacctgcgaaagggaggcatccatcctgagctatgatggtagcatgtacatgaagatcatcatgcccatggtcatgcatactgaggcagaggatgtgtccttccgcttcatgtcccagcgagcttatgggctgctggtggctacgacctccagggactctgccgacaccctgcgtctggagctggatggggggcgtgtcaagctcatggttaacttagactgtatcaggataaactgtaactccagcaaaggaccagagaccttgtatgcagggcagaagctcaatgacaacgagtggcacaccgttcgggtggtgcggagaggaaaaagccttaagttaaccgtggatgatgatgtggctgagggtacaatggtgggagaccatacccgtttggagttccacaacattgaaacgggaatcatgactgagaaacgctacatctccgttgtcccctccagctttattggccatctgcagagcctcatgtttaatggccttctctacattgacttgtgcaaaaatggtgacattgattattgtgagctgaaggctcgttttggactgaggaacatcatcgctgaccctgtcacctttaagaccaagagcagctacctgagccttgccactcttcaggcttacacctccatgcacctcttcttccagttcaagaccacctcaccagatggcttcattctcttcaatagtggtgatggcaatgacttcattgcagtcgagcttgtcaaggggtatatacactacgtttttgacctcggaaacggtcccaatgtgatcaaaggcaacagtgaccgccccctgaatgacaaccagtggcacaatgtcgtcatcactcgggacaatagtaacactcatagcctgaaagtggacaccaaagtggtcactcaggttatcaatggtgccaaaaatctggatttgaaaggtgatctctatatggctggtctggcccaaggcatgtacagcaacctcccaaagctcgtggcctctcgagatggctttcagggctgtctagcatcagtggacttgaatggacgcctgccagacctcatcaatgatgctcttcatcggagcggacagatcaagcgtggctgtgaaggacccagtaccacctgccaggaagattcatgtgccaaccagggggtctgcatgcaacaatgggagggcttcacctgtgattgttctatgacctcttattctggaaaccagtgcaatgatcctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcagccaacatcagatgatcttgtttcatctgctgaatgttcaagtgatgatgaagactttgttgaatgtgagccgagtacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaacaaaaaaagaaaaaagttaaaaaagaaaaaaacaccaaaaaacaaaaacaaacaaaaaaaaaaacccacaacccttatctggttctgaccagtgtgcgtgtaactttatgatctgaggggaaaaatggcttttgggtttttgtttatttttttgataatgactggacatcagaagaggaaaaaaactcaaaacaaaagcgagagagactattgccatatgaactcaaaagctatcatggtgttcactctacatatcaggttatggtgtctctagaatctgttgtttgtttcctataagatgctttgctgaacacatagcaaaattcatgtgacggatgataaattgattcgaaaagctggtcccccaggatctaatttcagaatttaccacccaaacccggaacagatgggtttagggctggtgttatcagagctattggctttacgtaacaatattgttcctgtccattcacccagccaaattgtgttaaagaggaaagccccacaaactaaaacagcctttcctagggaagaggaaggggaggtgggctggatctgtgactgattgaaatgcatgcaaataaaaaagacaatattaaagtctgttatcaaaccagacagtaggggagttcaactcgtgatggaaccacaaaaggtcacacaagccaaccatgtcatgccagagtacaaaacacatagttctttccccgccccgaatgtgacaatggttttcatagtggtttaattttgtagcctgacatttatggataactctgtccttccatttgctcacttctctcttcacccatcttttttaaaaacaaataaatgaataaagctgctgtgacacacacacaaaggaatttaatagtataatatatatataaat

SEQ ID NO: 307508 - DNA, 2854 bp, Homo sapiens
ggaccgggatttctcgttttaccatttggaagcgtacaattatcagtgtgcctgtaggataatgttcattcactggccagttgtccgcctgcagagatggcgttgccgccgttccaaatggtaaaacagaaaatccccttcaaatataatcggcctgtagaggagtggctgcaggaaaaaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcagccaacatcagatgatcttgtttcatctgctgaatgttcaagtgatgatgaagactttgttgaatgtgagccgagtacaggaggtgaattagttatccctcttcttgtagaagaccctttagctacccctcctattgctactcgtgcaccttccattacactcccccctacctttcgccccctcctcaccattattgagaccaccaaagattccctgtccatgacctctgaggcggggttaccttgcttgtcggaccaaggcagcgatggttgtgatgatgatggcttggtgatatctgggtatggctcaggggaaacctttgactctaacctgccccctactgatgatgaagatttttacaccaccttctccttggtaacagataagagtctttccacttcaatcttcgaaggtggctacaaagcacatgcgcccaagtgggaatccaaggactttagacctaacaaagtctccgaaactagtaggactactaccacatctttatcccctgagctgatccgcttcacagcttcctcctcgtctgggatggtgcccaaattgccagctggcaaaatgaataaccgtgatctcaaaccccagcctgatatagtcttgcttccgttgcccactgcctatgagctagacagcaccaaactgaagagcccactaattacttcccccatgttccgtaatgtgcccacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaacaaaaaaagaaaaaagttaaaaaagaaaaaaacaccaaaaaacaaaaacaaacaaaaaaaaaaacccacaacccttatctggttctgaccagtgtgcgtgtaactttatgatctgaggggaaaaatggcttttgggtttttgtttatttttttgataatgactggacatcagaagaggaaaaaaactcaaaacaaaagcgagagagactattgccatatgaactcaaaagctatcatggtgttcactctacatatcaggttatggtgtctctagaatctgttgtttgtttcctataagatgctttgctgaacacatagcaaaattcatgtgacggatgataaattgattcgaaaagctggtcccccaggatctaatttcagaatttaccacccaaacccggaacagatgggtttagggctggtgttatcagagctattggctttacgtaacaatattgttcctgtccattcacccagccaaattgtgttaaagaggaaagccccacaaactaaaacagcctttcctagggaagaggaaggggaggtgggctggatctgtgactgattgaaatgcatgcaaataaaaaagacaatattaaagtctgttatcaaaccagacagtaggggagttcaactcgtgatggaaccacaaaaggtcacacaagccaaccatgtcatgccagagtacaaaacacatagttctttccccgccccgaatgtgacaatggttttcatagtggtttaattttgtagcctgacatttatggataactctgtccttccatttgctcacttctctcttcacccatcttttttaaaaacaaataaatgaataaagctgctgtgacacacacacaaaggaatttaatagtataatatatatataaat

SEQ ID NO: 307509 - DNA, 2565 bp, Homo sapiens
caaaccccccaaagtaaaaatttgttaaagtgcagattttttttttctttttatgttatgtggtgtggatgtatgtgttgttgcctccctgtatcatcctctgttgtaaattattatatttgaaaaattagacattttgctcaaaagtttttaagaaatgacaacaaaaaaagcaagttacaagaatgtggcaattctatttgtccaagagcattcttacacaactttcttttgtaaatttttctttcatgccaaaaaacatgcgggcaatttgttgatgaggtgaattagttatccctcttcttgtagaagaccctttagctacccctcctattgctactcgtgcaccttccattacactcccccctacctttcgccccctcctcaccattattgagaccaccaaagattccctgtccatgacctctgaggcggggttaccttgcttgtcggaccaaggcagcgatggttgtgatgatgatggcttggtgatatctgggtatggctcaggggaaacctttgactctaacctgccccctactgatgatgaagatttttacaccaccttctccttggtaacagataagagtctttccacttcaatcttcgaaggtggctacaaagcacatgcgcccaagtgggaatccaaggactttagacctaacaaagtctccgaaactagtaggactactaccacatctttatcccctgagctgatccgcttcacagcttcctcctcgtctgggatggtgcccaaattgccagctggcaaaatgaataaccgtgatctcaaaccccagcctgatatagtcttgcttccgttgcccactgcctatgagctagacagcaccaaactgaagagcccactaattacttcccccatgttccgtaatgtgcccacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaacaaaaaaagaaaaaagttaaaaaagaaaaaaacaccaaaaaacaaaaacaaacaaaaaaaaaaacccacaacccttatctggttctgaccagtgtgcgtgtaactttatgatctgaggggaaaaatggcttttgggtttttgtttatttttttgataatgactggacatcagaagaggaaaaaaactcaaaacaaaagcgagagagactattgccatatgaactcaaaagctatcatggtgttcactctacatatcaggttatggtgtctctagaatctgttgtttgtttcctataagatgctttgctgaacacatagcaaaattcatgtgacggatgataaattgattcgaaaagctggtcccccaggatctaatttcagaatttaccacccaaacccggaacagatgggtttagggctggtgttatcagagctattggctttacgtaacaatattgttcctgtccattcacccagccaaattgtgttaaagaggaaagccccacaaactaaaacagcctttcctagggaagaggaaggggaggtgggctggatctgtgactgattgaaatgcatgcaaataaaaaagacaatattaaagtctgttatcaaaccagacagtaggggagttcaactcgtgatggaaccacaaaaggtcacacaagccaaccatgtcatgccagagtacaaaacacatagttctttccccgccccgaatgtgacaatggttttcatagtggtttaattttgtagcctgacatttatggataactctgtccttccatttgctcacttctctcttcacccatcttttttaaaaacaaataaatgaataaagctgctgtgacacacacacaaaggaatttaatagtataatatatatataaat

SEQ ID NO: 307510 - DNA, 381 bp, Homo sapiens
gatctctcttgatttttatttgcaagcttatgttgtataactttctgacaacacaagaaattggccaggagacaaaagaaattctgtagaaatatagaggcttttttggagcttgtgtgcacatcagatgtttcttcagatacctttttggttcctgtgtctcattgtttctcatgttgttttgggctatgtcctgaagcctctttttgggtcatttttccaggtgcccagtgagtgatggatggatactgtttgcaagattgattcacatggcacttttgtttggcttttgacaggttgtttataagaataatgacatccgtctggagctgtctcgcctggcccggattgcggacaccaagatgaaaatctatggcgaag

SEQ ID NO: 307511 - DNA, 1977 bp, Homo sapiens
  misc_feature (9)..(9): n is a, c, g, or t
agcggaggngtgcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagccaagagtttactcaacaagaaagcagatggagtcaaggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaacaggcttccacggacttcacgtcattattggctcaactttcctcactatctgcttcatccgccaactaatatttcaccttacatccaaacatcactttggcttcgaagccgccgcctgatactggcattttgtagatgtggtttgactatt

SEQ ID NO: 307512 - DNA, 4050 bp, Homo sapiens
  misc_feature (9)..(9): n is a, c, g, or t
agcggaggngtgcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagtgggcagacagaccaccgctccggccacaatgtccaccgcggcctccggcaccaccatggggctggtggaacaagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaaaaaaaaaaacaaaaaaaactaaaggaaggaaaaagctgtaaaaatcactggcattcgtggggccactccccacccaagctccacgtgtgtccgtctgtgctcctggcctctgggggaccagctgggacatgaacttgtctgccaggcccccgtcgcgtgctgaacggtgttagtttgtaggtaacgcacacaccccacacctaaggtgtctgcatcctcctgccaacgcatgggctccacgtggtgtgctcgctggctgtcgtgactgtcagctgtctcttgggaggggctgtgggggcccgctgggctggcctcctttcccgctagttgtgcctgagagttgctgttgttcctgctttcccttcccttcctttcatcccctgaagggctaggtgtgggttttccgtgcccggtatccccacacacccagcacggacaacccttcggcagagcccaggccggcccctcaccccctggagtattgaaactggagtcccgtccccaaggccttcagagatgcccctacacacccagggctccagctctggtccttctgggggagtaaagtgcaaagaggggcacagcttagttttgggcctctcgccgagcaagagacagcactgctggctacagctccaacacagccagctgtggcaagaggactctgcctgggctggcccccctcctgtgtgaggtgtctgtcccttctctgctggccagcagcagatgcactggcagctcccaaccctgtttccgcccctcggccctcccccagcctgttcggcttctctgcagcccgcaagggggagcagacttttgacaaaggactgcgggcctcgctcaagtccctgagcccccagctgaagctgggaggggaggccaggctttgtgtctgggcatattcgtctgctgatggggtttggggaagcctggggcttggggtttggtcgggtggtgcagctagtggcagagcgggatcagaggtggtggctgcccagcttctgggctgagacaagggtctgtgcaggggtttactgaagtgggagtgcctttggaatctgggccgggagcagaagggagcaaaagctacagtgggagccagcctagggcacatgggaggcgtgagggcagtgctgcccgtgcagtgtcaggtgtgccagtgccttggcgggctgcagtgcgtgtgagggcaccttctaggtgggccagggatgcagctatggagataaggcgggctggggacagaaacaggtgggcacagggcccaggacaccagcggatggagggcagggtctagccctgtgctcctgagcgtcggctgcctgggttcgaggcggtgggtccccggccccttgtgatggtgtgtaccatgggggagctcggggacagggcaagcccgagcatggtggggctgcagggtgggtctgaagccaggttgggtgggggtggtcacaagccctgactgcagagggtcaggggctcctgccccagtgcctgcccactttcaattcacattgttttcaacaaggattttctttatcttcccctacaaatcaagccaagggaggggcacagaatggggaacaggacacaggatcctaaactccaaggggactgtccaccgatgaacactcagagtggacaccatcttccgtccacgctgtgcccaggacagctgtccccatccatgaacacagggtaaacatctgccgggctccgcaccagtggctccctgggccatgggacagcggcagggctcaccacggacagcacgtggcccagcagccggccaccctggcgtcctggggcctcctcccctcctctccctctcaccttgtcacctccacggagctgcctgtctgggataatttggggattttttttctgggggataattcttttgcatgacccctaaagagcaagccacaccggtctgctagctaggtgtccgcggtgtggtggtggcggccgct

SEQ ID NO: 307513 - DNA, 3975 bp, Homo sapiens
  misc_feature (9)..(9): n is a, c, g, or t
agcggaggngtgcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaaaaaaaaaaacaaaaaaaactaaaggaaggaaaaagctgtaaaaatcactggcattcgtggggccactccccacccaagctccacgtgtgtccgtctgtgctcctggcctctgggggaccagctgggacatgaacttgtctgccaggcccccgtcgcgtgctgaacggtgttagtttgtaggtaacgcacacaccccacacctaaggtgtctgcatcctcctgccaacgcatgggctccacgtggtgtgctcgctggctgtcgtgactgtcagctgtctcttgggaggggctgtgggggcccgctgggctggcctcctttcccgctagttgtgcctgagagttgctgttgttcctgctttcccttcccttcctttcatcccctgaagggctaggtgtgggttttccgtgcccggtatccccacacacccagcacggacaacccttcggcagagcccaggccggcccctcaccccctggagtattgaaactggagtcccgtccccaaggccttcagagatgcccctacacacccagggctccagctctggtccttctgggggagtaaagtgcaaagaggggcacagcttagttttgggcctctcgccgagcaagagacagcactgctggctacagctccaacacagccagctgtggcaagaggactctgcctgggctggcccccctcctgtgtgaggtgtctgtcccttctctgctggccagcagcagatgcactggcagctcccaaccctgtttccgcccctcggccctcccccagcctgttcggcttctctgcagcccgcaagggggagcagacttttgacaaaggactgcgggcctcgctcaagtccctgagcccccagctgaagctgggaggggaggccaggctttgtgtctgggcatattcgtctgctgatggggtttggggaagcctggggcttggggtttggtcgggtggtgcagctagtggcagagcgggatcagaggtggtggctgcccagcttctgggctgagacaagggtctgtgcaggggtttactgaagtgggagtgcctttggaatctgggccgggagcagaagggagcaaaagctacagtgggagccagcctagggcacatgggaggcgtgagggcagtgctgcccgtgcagtgtcaggtgtgccagtgccttggcgggctgcagtgcgtgtgagggcaccttctaggtgggccagggatgcagctatggagataaggcgggctggggacagaaacaggtgggcacagggcccaggacaccagcggatggagggcagggtctagccctgtgctcctgagcgtcggctgcctgggttcgaggcggtgggtccccggccccttgtgatggtgtgtaccatgggggagctcggggacagggcaagcccgagcatggtggggctgcagggtgggtctgaagccaggttgggtgggggtggtcacaagccctgactgcagagggtcaggggctcctgccccagtgcctgcccactttcaattcacattgttttcaacaaggattttctttatcttcccctacaaatcaagccaagggaggggcacagaatggggaacaggacacaggatcctaaactccaaggggactgtccaccgatgaacactcagagtggacaccatcttccgtccacgctgtgcccaggacagctgtccccatccatgaacacagggtaaacatctgccgggctccgcaccagtggctccctgggccatgggacagcggcagggctcaccacggacagcacgtggcccagcagccggccaccctggcgtcctggggcctcctcccctcctctccctctcaccttgtcacctccacggagctgcctgtctgggataatttggggattttttttctgggggataattcttttgcatgacccctaaagagcaagccacaccggtctgctagctaggtgtccgcggtgtggtggtggcggccgct

SEQ ID NO: 307514 - DNA, 3930 bp, Homo sapiens
  misc_feature (9)..(9): n is a, c, g, or t
agcggaggngtgcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagccaagagtttactcaacaagaaagcagatggagtcaagccccagacgaatagcaccaaaaacagtgcagccgccaccagccccaaagggacgcttcctcctgccgccctggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaaaaaaaaaaacaaaaaaaactaaaggaaggaaaaagctgtaaaaatcactggcattcgtggggccactccccacccaagctccacgtgtgtccgtctgtgctcctggcctctgggggaccagctgggacatgaacttgtctgccaggcccccgtcgcgtgctgaacggtgttagtttgtaggtaacgcacacaccccacacctaaggtgtctgcatcctcctgccaacgcatgggctccacgtggtgtgctcgctggctgtcgtgactgtcagctgtctcttgggaggggctgtgggggcccgctgggctggcctcctttcccgctagttgtgcctgagagttgctgttgttcctgctttcccttcccttcctttcatcccctgaagggctaggtgtgggttttccgtgcccggtatccccacacacccagcacggacaacccttcggcagagcccaggccggcccctcaccccctggagtattgaaactggagtcccgtccccaaggccttcagagatgcccctacacacccagggctccagctctggtccttctgggggagtaaagtgcaaagaggggcacagcttagttttgggcctctcgccgagcaagagacagcactgctggctacagctccaacacagccagctgtggcaagaggactctgcctgggctggcccccctcctgtgtgaggtgtctgtcccttctctgctggccagcagcagatgcactggcagctcccaaccctgtttccgcccctcggccctcccccagcctgttcggcttctctgcagcccgcaagggggagcagacttttgacaaaggactgcgggcctcgctcaagtccctgagcccccagctgaagctgggaggggaggccaggctttgtgtctgggcatattcgtctgctgatggggtttggggaagcctggggcttggggtttggtcgggtggtgcagctagtggcagagcgggatcagaggtggtggctgcccagcttctgggctgagacaagggtctgtgcaggggtttactgaagtgggagtgcctttggaatctgggccgggagcagaagggagcaaaagctacagtgggagccagcctagggcacatgggaggcgtgagggcagtgctgcccgtgcagtgtcaggtgtgccagtgccttggcgggctgcagtgcgtgtgagggcaccttctaggtgggccagggatgcagctatggagataaggcgggctggggacagaaacaggtgggcacagggcccaggacaccagcggatggagggcagggtctagccctgtgctcctgagcgtcggctgcctgggttcgaggcggtgggtccccggccccttgtgatggtgtgtaccatgggggagctcggggacagggcaagcccgagcatggtggggctgcagggtgggtctgaagccaggttgggtgggggtggtcacaagccctgactgcagagggtcaggggctcctgccccagtgcctgcccactttcaattcacattgttttcaacaaggattttctttatcttcccctacaaatcaagccaagggaggggcacagaatggggaacaggacacaggatcctaaactccaaggggactgtccaccgatgaacactcagagtggacaccatcttccgtccacgctgtgcccaggacagctgtccccatccatgaacacagggtaaacatctgccgggctccgcaccagtggctccctgggccatgggacagcggcagggctcaccacggacagcacgtggcccagcagccggccaccctggcgtcctggggcctcctcccctcctctccctctcaccttgtcacctccacggagctgcctgtctgggataatttggggattttttttctgggggataattcttttgcatgacccctaaagagcaagccacaccggtctgctagctaggtgtccgcggtgtggtggtggcggccgct

SEQ ID NO: 307515 - DNA, 4102 bp, Homo sapiens
  misc_feature (9)..(9): n is a, c, g, or t
agcggaggngtgcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagtgggcagacagaccaccgctccggccacaatgtccaccgcggcctccggcaccaccatggggctggtggaacaagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaaaaaaaaaaacaaaaaaaactaaaggaaggaaaaagctgtaaaaatcactggcattcgtggggccactccccacccaagctccacgtgtgtccgtctgtgctcctggcctctgggggaccagctgggacatgaacttgtctgccaggcccccgtcgcgtgctgaacggtgttagtttgtaggtaacgcacacaccccacacctaaggtgtctgcatcctcctgccaacgcatgggctccacgtggtgtgctcgctggctgtcgtgactgtcagctgtctcttgggaggggctgtgggggcccgctgggctggcctcctttcccgctagttgtgcctgagagttgctgttgttcctgctttcccttcccttcctttcatcccctgaagggctaggtgtgggttttccgtgcccggtatccccacacacccagcacggacaacccttcggcagagcccaggccggcccctcaccccctggagtattgaaactggagtcccgtccccaaggccttcagagatgcccctacacacccagggctccagctctggtccttctgggggagtaaagtgcaaagaggggcacagcttagttttgggcctctcgccgagcaagagacagcactgctggctacagctccaacacagccagctgtggcaagaggactctgcctgggctggcccccctcctgtgtgaggtgtctgtcccttctctgctggccagcagcagatgcactggcagctcccaaccctgtttccgcccctcggccctcccccagcctgttcggcttctctgcagcccgcaagggggagcagacttttgacaaaggactgcgggcctcgctcaagtccctgagcccccagctgaagctgggaggggaggccaggctttgtgtctgggcatattcgtctgctgatggggtttggggaagcctggggcttggggtttggtcgggtggtgcagctagtggcagagcgggatcagaggtggtggctgcccagcttctgggctgagacaagggtctgtgcaggggtttactgaagtgggagtgcctttggaatctgggccgggagcagaagggagcaaaagctacagtgggagccagcctagggcacatgggaggcgtgagggcagtgctgcccgtgcagtgtcaggtgtgccagtgccttggcgggctgcagtgcgtgtgagggcaccttctaggtgggccagggatgcagctatggagataaggcgggctggggacagaaacaggtgggcacagggcccaggacaccagcggatggagggcagggtctagccctgtgctcctgagcgtcggctgcctgggttcgaggcggtgggtccccggccccttgtgatggtgtgtaccatgggggagctcggggacagggcaagcccgagcatggtggggctgcagggtgggtctgaagccaggttgggtgggggtggtcacaagccctgactgcagagggtcaggggctcctgccccagtgcctgcccactttcaattcacattgttttcaacaaggattttctttatcttcccctacaaatcaagccaagggaggggcacagaatggggaacaggacacaggatcctaaactccaaggggactgtccaccgatgaacactcagagtggacaccatcttccgtccacgctgtgcccaggacagctgtccccatccatgaacacagggtaaacatctgccgggctccgcaccagtggctccctgggccatgggacagcggcagggctcaccacggacagcacgtggcccagcagccggccaccctggcgtcctggggcctcctcccctcctctccctctcaccttgtcacctccacggagctgcctgtctgggataatttggggattttttttctgggggataattcttttgcatgacccctaaagagcaagccacaccggtctgctagctaggtgttccccaagagtgggggggaggaaggcccctttggccaaccccctttaaagggggttagggttttgcccacacggagg

SEQ ID NO: 307516 - DNA, 4416 bp, Homo sapiens
  misc_feature (9)..(9): n is a, c, g, or t
agcggaggngtgcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagtgggcagacagaccaccgctccggccacaatgtccaccgcggcctccggcaccaccatggggctggtggaacaagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccccagggtccccgacatcctgagctcagtgaggaggggctcgggagccagaagccgaggggcccctgcctgcccatctccggctccctttagccccctgccagccccatcccccaggatctctgacatcctgaactctgtgagaaggggttcaggaaccccagaagccgagggccccctctcagcggggcccccgccctgcctgtctccggctctcctaggccccctgtcctccccgtcccccaggatctctgacatcctgaactctgtgaggaggggctcagggaccccagaagccgaggcccctcgccagtggcccccgccctgcccatctccgactatccctggccccctgcccaccccatcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaaaaaaaaaaacaaaaaaaactaaaggaaggaaaaagctgtaaaaatcactggcattcgtggggccactccccacccaagctccacgtgtgtccgtctgtgctcctggcctctgggggaccagctgggacatgaacttgtctgccaggcccccgtcgcgtgctgaacggtgttagtttgtaggtaacgcacacaccccacacctaaggtgtctgcatcctcctgccaacgcatgggctccacgtggtgtgctcgctggctgtcgtgactgtcagctgtctcttgggaggggctgtgggggcccgctgggctggcctcctttcccgctagttgtgcctgagagttgctgttgttcctgctttcccttcccttcctttcatcccctgaagggctaggtgtgggttttccgtgcccggtatccccacacacccagcacggacaacccttcggcagagcccaggccggcccctcaccccctggagtattgaaactggagtcccgtccccaaggccttcagagatgcccctacacacccagggctccagctctggtccttctgggggagtaaagtgcaaagaggggcacagcttagttttgggcctctcgccgagcaagagacagcactgctggctacagctccaacacagccagctgtggcaagaggactctgcctgggctggcccccctcctgtgtgaggtgtctgtcccttctctgctggccagcagcagatgcactggcagctcccaaccctgtttccgcccctcggccctcccccagcctgttcggcttctctgcagcccgcaagggggagcagacttttgacaaaggactgcgggcctcgctcaagtccctgagcccccagctgaagctgggaggggaggccaggctttgtgtctgggcatattcgtctgctgatggggtttggggaagcctggggcttggggtttggtcgggtggtgcagctagtggcagagcgggatcagaggtggtggctgcccagcttctgggctgagacaagggtctgtgcaggggtttactgaagtgggagtgcctttggaatctgggccgggagcagaagggagcaaaagctacagtgggagccagcctagggcacatgggaggcgtgagggcagtgctgcccgtgcagtgtcaggtgtgccagtgccttggcgggctgcagtgcgtgtgagggcaccttctaggtgggccagggatgcagctatggagataaggcgggctggggacagaaacaggtgggcacagggcccaggacaccagcggatggagggcagggtctagccctgtgctcctgagcgtcggctgcctgggttcgaggcggtgggtccccggccccttgtgatggtgtgtaccatgggggagctcggggacagggcaagcccgagcatggtggggctgcagggtgggtctgaagccaggttgggtgggggtggtcacaagccctgactgcagagggtcaggggctcctgccccagtgcctgcccactttcaattcacattgttttcaacaaggattttctttatcttcccctacaaatcaagccaagggaggggcacagaatggggaacaggacacaggatcctaaactccaaggggactgtccaccgatgaacactcagagtggacaccatcttccgtccacgctgtgcccaggacagctgtccccatccatgaacacagggtaaacatctgccgggctccgcaccagtggctccctgggccatgggacagcggcagggctcaccacggacagcacgtggcccagcagccggccaccctggcgtcctggggcctcctcccctcctctccctctcaccttgtcacctccacggagctgcctgtctgggataatttggggattttttttctgggggataattcttttgcatgacccctaaagagcaagccacaccggtctgctagctaggtgtccgcggtgtggtggtggcggccgct

SEQ ID NO: 307517 - DNA, 3886 bp, Homo sapiens
  misc_feature (9)..(9): n is a, c, g, or t
agcggaggngtgcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagtgggcagacagaccaccgctccggccacaatgtccaccgcggcctccggcaccaccatggggctggtggaacaagccaagagtttactcaacaagaaagcagatggagtcaaggagcctcaaaccaccgtcatccataacccagtggacgggattaaggagtcttctgacagtgccaataccaccatagaggatgaagacgctaaagcccggaagcaggagatcattaagaccacggagcagctcatcgaggccgtcaacaacggtgactttgaggcctacgcacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaaaaaaaaaaacaaaaaaaactaaaggaaggaaaaagctgtaaaaatcactggcattcgtggggccactccccacccaagctccacgtgtgtccgtctgtgctcctggcctctgggggaccagctgggacatgaacttgtctgccaggcccccgtcgcgtgctgaacggtgttagtttgtaggtaacgcacacaccccacacctaaggtgtctgcatcctcctgccaacgcatgggctccacgtggtgtgctcgctggctgtcgtgactgtcagctgtctcttgggaggggctgtgggggcccgctgggctggcctcctttcccgctagttgtgcctgagagttgctgttgttcctgctttcccttcccttcctttcatcccctgaagggctaggtgtgggttttccgtgcccggtatccccacacacccagcacggacaacccttcggcagagcccaggccggcccctcaccccctggagtattgaaactggagtcccgtccccaaggccttcagagatgcccctacacacccagggctccagctctggtccttctgggggagtaaagtgcaaagaggggcacagcttagttttgggcctctcgccgagcaagagacagcactgctggctacagctccaacacagccagctgtggcaagaggactctgcctgggctggcccccctcctgtgtgaggtgtctgtcccttctctgctggccagcagcagatgcactggcagctcccaaccctgtttccgcccctcggccctcccccagcctgttcggcttctctgcagcccgcaagggggagcagacttttgacaaaggactgcgggcctcgctcaagtccctgagcccccagctgaagctgggaggggaggccaggctttgtgtctgggcatattcgtctgctgatggggtttggggaagcctggggcttggggtttggtcgggtggtgcagctagtggcagagcgggatcagaggtggtggctgcccagcttctgggctgagacaagggtctgtgcaggggtttactgaagtgggagtgcctttggaatctgggccgggagcagaagggagcaaaagctacagtgggagccagcctagggcacatgggaggcgtgagggcagtgctgcccgtgcagtgtcaggtgtgccagtgccttggcgggctgcagtgcgtgtgagggcaccttctaggtgggccagggatgcagctatggagataaggcgggctggggacagaaacaggtgggcacagggcccaggacaccagcggatggagggcagggtctagccctgtgctcctgagcgtcggctgcctgggttcgaggcggtgggtccccggccccttgtgatggtgtgtaccatgggggagctcggggacagggcaagcccgagcatggtggggctgcagggtgggtctgaagccaggttgggtgggggtggtcacaagccctgactgcagagggtcaggggctcctgccccagtgcctgcccactttcaattcacattgttttcaacaaggattttctttatcttcccctacaaatcaagccaagggaggggcacagaatggggaacaggacacaggatcctaaactccaaggggactgtccaccgatgaacactcagagtggacaccatcttccgtccacgctgtgcccaggacagctgtccccatccatgaacacagggtaaacatctgccgggctccgcaccagtggctccctgggccatgggacagcggcagggctcaccacggacagcacgtggcccagcagccggccaccctggcgtcctggggcctcctcccctcctctccctctcaccttgtcacctccacggagctgcctgtctgggataatttggggattttttttctgggggataattcttttgcatgacccctaaagagcaagccacaccggtctgctagctaggtgtccgcggtgtggtggtggcggccgct

SEQ ID NO: 307518 - DNA, 3774 bp, Homo sapiens
  misc_feature (9)..(9): n is a, c, g, or t
agcggaggngtgcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaaccacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaaaaaaaaaaacaaaaaaaactaaaggaaggaaaaagctgtaaaaatcactggcattcgtggggccactccccacccaagctccacgtgtgtccgtctgtgctcctggcctctgggggaccagctgggacatgaacttgtctgccaggcccccgtcgcgtgctgaacggtgttagtttgtaggtaacgcacacaccccacacctaaggtgtctgcatcctcctgccaacgcatgggctccacgtggtgtgctcgctggctgtcgtgactgtcagctgtctcttgggaggggctgtgggggcccgctgggctggcctcctttcccgctagttgtgcctgagagttgctgttgttcctgctttcccttcccttcctttcatcccctgaagggctaggtgtgggttttccgtgcccggtatccccacacacccagcacggacaacccttcggcagagcccaggccggcccctcaccccctggagtattgaaactggagtcccgtccccaaggccttcagagatgcccctacacacccagggctccagctctggtccttctgggggagtaaagtgcaaagaggggcacagcttagttttgggcctctcgccgagcaagagacagcactgctggctacagctccaacacagccagctgtggcaagaggactctgcctgggctggcccccctcctgtgtgaggtgtctgtcccttctctgctggccagcagcagatgcactggcagctcccaaccctgtttccgcccctcggccctcccccagcctgttcggcttctctgcagcccgcaagggggagcagacttttgacaaaggactgcgggcctcgctcaagtccctgagcccccagctgaagctgggaggggaggccaggctttgtgtctgggcatattcgtctgctgatggggtttggggaagcctggggcttggggtttggtcgggtggtgcagctagtggcagagcgggatcagaggtggtggctgcccagcttctgggctgagacaagggtctgtgcaggggtttactgaagtgggagtgcctttggaatctgggccgggagcagaagggagcaaaagctacagtgggagccagcctagggcacatgggaggcgtgagggcagtgctgcccgtgcagtgtcaggtgtgccagtgccttggcgggctgcagtgcgtgtgagggcaccttctaggtgggccagggatgcagctatggagataaggcgggctggggacagaaacaggtgggcacagggcccaggacaccagcggatggagggcagggtctagccctgtgctcctgagcgtcggctgcctgggttcgaggcggtgggtccccggccccttgtgatggtgtgtaccatgggggagctcggggacagggcaagcccgagcatggtggggctgcagggtgggtctgaagccaggttgggtgggggtggtcacaagccctgactgcagagggtcaggggctcctgccccagtgcctgcccactttcaattcacattgttttcaacaaggattttctttatcttcccctacaaatcaagccaagggaggggcacagaatggggaacaggacacaggatcctaaactccaaggggactgtccaccgatgaacactcagagtggacaccatcttccgtccacgctgtgcccaggacagctgtccccatccatgaacacagggtaaacatctgccgggctccgcaccagtggctccctgggccatgggacagcggcagggctcaccacggacagcacgtggcccagcagccggccaccctggcgtcctggggcctcctcccctcctctccctctcaccttgtcacctccacggagctgcctgtctgggataatttggggattttttttctgggggataattcttttgcatgacccctaaagagcaagccacaccggtctgctagctaggtgtccgcggtgtggtggtggcggccgct

SEQ ID NO: 307519 - DNA, 3731 bp, Homo sapiens
gaggctgcgttcattatgtgcactcttctgtgttatgtgagagcgaggggtcggcagcagcaagtggcctgcgtgcgcgaggggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagccaagagtttactcaacaagaaagcagatggagtcaagccccagacgaatagcaccaaaaacagtgcagccgccaccagccccaaagggacgcttcctcctgccgccctggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaaaaaaaaaaacaaaaaaaactaaaggaaggaaaaagctgtaaaaatcactggcattcgtggggccactccccacccaagctccacgtgtgtccgtctgtgctcctggcctctgggggaccagctgggacatgaacttgtctgccaggcccccgtcgcgtgctgaacggtgttagtttgtaggtaacgcacacaccccacacctaaggtgtctgcatcctcctgccaacgcatgggctccacgtggtgtgctcgctggctgtcgtgactgtcagctgtctcttgggaggggctgtgggggcccgctgggctggcctcctttcccgctagttgtgcctgagagttgctgttgttcctgctttcccttcccttcctttcatcccctgaagggctaggtgtgggttttccgtgcccggtatccccacacacccagcacggacaacccttcggcagagcccaggccggcccctcaccccctggagtattgaaactggagtcccgtccccaaggccttcagagatgcccctacacacccagggctccagctctggtccttctgggggagtaaagtgcaaagaggggcacagcttagttttgggcctctcgccgagcaagagacagcactgctggctacagctccaacacagccagctgtggcaagaggactctgcctgggctggcccccctcctgtgtgaggtgtctgtcccttctctgctggccagcagcagatgcactggcagctcccaaccctgtttccgcccctcggccctcccccagcctgttcggcttctctgcagcccgcaagggggagcagacttttgacaaaggactgcgggcctcgctcaagtccctgagcccccagctgaagctgggaggggaggccaggctttgtgtctgggcatattcgtctgctgatggggtttggggaagcctggggcttggggtttggtcgggtggtgcagctagtggcagagcgggatcagaggtggtggctgcccagcttctgggctgagacaagggtctgtgcaggggtttactgaagtgggagtgcctttggaatctgggccgggagcagaagggagcaaaagctacagtgggagccagcctagggcacatgggaggcgtgagggcagtgctgcccgtgcagtgtcaggtgtgccagtgccttggcgggctgcagtgcgtgtgagggcaccttctaggtgggccagggatgcagctatggagataaggcgggctggggacagaaacaggtgggcacagggcccaggacaccagcggatggagggcagggtctagccctgtgctcctgagcgtcggctgcctgggttcgaggcggtgggtccccggccccttgtgatggtgtgtaccatgggggagctcggggacagggcaagcccgagcatggtggggctgcagggtgggtctgaagccaggttgggtgggggtggtcacaagccctgactgcagagggtcaggggctcctgccccagtgcctgcccactttcaattcacattgttttcaacaaggattttctttatcttcccctacaaatcaagccaagggaggggcacagaatggggaacaggacacaggatcctaaactccaaggggactgtccaccgatgaacactcagagtggacaccatcttccgtccacgctgtgcccaggacagctgtccccatccatgaacacagggtaaacatctgccgggctccgcaccagtggctccctgggccatgggacagcggcagggctcaccacggacagcacgtggcccagcagccggccaccctggcgtcctggggcctcctcccctcctctccctctcaccttgtcacctccacggagctgcctgtctgggataatttggggattttttttctgggggataattcttttgcatgacccctaaagagcaagccacaccggtctgctagctaggtgtccgcggtgtggtggtggcggccgct

SEQ ID NO: 307520 - DNA, 3730 bp, Homo sapiens
gaggctgcgttcattatgtgcactcttctgtgttatgtgagagcgaggggtcggcagcagcaagtggcctgcgtgcgcgaggggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagtgggcagacagaccaccgctccggccacaatgtccaccgcggcctccggcaccaccatggggctggtggaacaagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaaaaaaaaaaacaaaaaaaactaaaggaaggaaaaagctgtaaaaatcactggcattcgtggggccactccccacccaagctccacgtgtgtccgtctgtgctcctggcctctgggggaccagctgggacatgaacttgtctgccaggcccccgtcgcgtgctgaacggtgttagtttgtaggtaacgcacacaccccacacctaaggtgtctgcatcctcctgccaacgcatgggctccacgtggtgtgctcgctggctgtcgtgactgtcagctgtctcttgggaggggctgtgggggcccgctgggctggcctcctttcccgctagttgtgcctgagagttgctgttgttcctgctttcccttcccttcctttcatcccctgaagggctaggtgtgggttttccgtgcccggtatccccacacacccagcacggacaacccttcggcagagcccaggccggcccctcaccccctggagtattgaaactggagtcccgtccccaaggccttcagagatgcccctacacacccagggctccagctctggtccttctgggggagtaaagtgcaaagaggggcacagcttagttttgggcctctcgccgagcaagagacagcactgctggctacagctccaacacagccagctgtggcaagaggactctgcctgggctggcccccctcctgtgtgaggtgtctgtcccttctctgctggccagcagcagatgcactggcagctcccaaccctgtttccgcccctcggccctcccccagcctgttcggcttctctgcagcccgcaagggggagcagacttttgacaaaggactgcgggcctcgctcaagtccctgagcccccagctgaagctgggaggggaggccaggctttgtgtctgggcatattcgtctgctgatggggtttggggaagcctggggcttggggtttggtcgggtggtgcagctagtggcagagcgggatcagaggtggtggctgcccagcttctgggctgagacaagggtctgtgcaggggtttactgaagtgggagtgcctttggaatctgggccgggagcagaagggagcaaaagctacagtgggagccagcctagggcacatgggaggcgtgagggcagtgctgcccgtgcagtgtcaggtgtgccagtgccttggcgggctgcagtgcgtgtgagggcaccttctaggtgggccagggatgcagctatggagataaggcgggctggggacagaaacaggtgggcacagggcccaggacaccagcggatggagggcagggtctagccctgtgctcctgagcgtcggctgcctgggttcgaggcggtgggtccccggccccttgtgatggtgtgtaccatgggggagctcggggacagggcaagcccgagcatggtggggctgcagggtgggtctgaagccaggttgggtgggggtggtcacaagccctgactgcagagggtcaggggctcctgccccagtgcctgcccactttcaattcacattgttttcaacaaggattttctttatcttcccctacaaatcaagccaagggaggggcacagaatggggaacaggacacaggatcctaaactccaaggggactgtccaccgatgaacactcagagtggacaccatcttccgtccacgctgtgcccaggacagctgtccccatccatgaacacagggtaaacatctgccgggctccgcaccagtggctccctgggccatgggacagcggcagggctcaccacggacagcacgtggcccagcagccggccaccctggcgtcctggggcctcctcccctcctctccctctcaccttgtcacctccacggagctgcctgtctgggataatttggggattttttttctgggggataattcttttgcatgacccctaaagagcaagccacaccggtctgctagctaggtgtccgcggtgtggtggtggcggccgct

SEQ ID NO: 307521 - DNA, 3782 bp, Homo sapiens
  misc_feature (9)..(9): n is a, c, g, or t
agcggaggngtgcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagtgggcagacagaccaccgctccggccacaatgtccaccgcggcctccggcaccaccatggggctggtggaacaagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaaaaaaaaaaacaaaaaaaactaaaggaaggaaaaagctgtaaaaatcactggcattcgtggggccactccccacccaagctccacgtgtgtccgtctgtgctcctggcctctgggggaccagctgggacatgaacttgtctgccaggcccccgtcgcgtgctgaacggtgttagtttgtaggtaacgcacacaccccacacctaaggtgtctgcatcctcctgccaacgcatgggctccacgtggtgtgctcgctggctgtcgtgactgtcagctgtctcttgggaggggctgtgggggcccgctgggctggcctcctttcccgctagttgtgcctgagagttgctgttgttcctgctttcccttcccttcctttcatcccctgaagggctaggtgtgggttttccgtgcccggtatccccacacacccagcacggacaacccttcggcagagcccaggccggcccctcaccccctggagtattgaaactggagtcccgtccccaaggccttcagagatgcccctacacacccagggctccagctctggtccttctgggggagtaaagtgcaaagaggggcacagcttagttttgggcctctcgccgagcaagagacagcactgctggctacagctccaacacagccagctgtggcaagaggactctgcctgggctggcccccctcctgtgtgaggtgtctgtcccttctctgctggccagcagcagatgcactggcagctcccaaccctgtttccgcccctcggccctcccccagcctgttcggcttctctgcagcccgcaagggggagcagacttttgacaaaggactgcgggcctcgctcaagtccctgagcccccagctgaagctgggaggggaggccaggctttgtgtctgggcatattcgtctgctgatggggtttggggaagcctggggcttggggtttggtcgggtggtgcagctagtggcagagcgggatcagaggtggtggctgcccagcttctgggctgagacaagggtctgtgcaggggtttactgaagtgggagtgcctttggaatctgggccgggagcagaagggagcaaaagctacagtgggagccagcctagggcacatgggaggcgtgagggcagtgctgcccgtgcagtgtcaggtgtgccagtgccttggcgggctgcagtgcgtgtgagggcaccttctaggtgggccagggatgcagctatggagataaggcgggctggggacagaaacaggtgggcacagggcccaggacaccagcggatggagggcagggtctagccctgtgctcctgagcgtcggctgcctgggttcgaggcggtgggtccccggccccttgtgatggtgtgtaccatgggggagctcggggacagggcaagcccgagcatggtggggctgcagggtgggtctgaagccaggttgggtgggggtggtcacaagccctgactgcagagggtcaggggctcctgccccagtgcctgcccactttcaattcacattgttttcaacaaggattttctttatcttcccctacaaatcaagccaagggaggggcacagaatggggaacaggacacaggatcctaaactccaaggggactgtccaccgatgaacactcagagtggacaccatcttccgtccacgctgtgcccaggacagctgttaccattctgatgttggagcggccgc

SEQ ID NO: 307522 - DNA, 2692 bp, Homo sapiens
gacaccagactgggggtggtgtggagatactcttagagaagaggctgctgggcacgggtcggcatggcagggcagtggctagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaaaaaaaaaaacaaaaaaaactaaaggaaggaaaaagctgtaaaaatcactggcattcgtggggccactccccacccaagctccacgtgtgtccgtctgtgctcctggcctctgggggaccagctgggacatgaacttgtctgccaggcccccgtcgcgtgctgaacggtgttagtttgtaggtaacgcacacaccccacacctaaggtgtctgcatcctcctgccaacgcatgggctccacgtggtgtgctcgctggctgtcgtgactgtcagctgtctcttgggaggggctgtgggggcccgctgggctggcctcctttcccgctagttgtgcctgagagttgctgttgttcctgctttcccttcccttcctttcatcccctgaagggctaggtgtgggttttccgtgcccggtatccccacacacccagcacggacaacccttcggcagagcccaggccggcccctcaccccctggagtattgaaactggagtcccgtccccaaggccttcagagatgcccctacacacccagggctccagctctggtccttctgggggagtaaagtgcaaagaggggcacagcttagttttgggcctctcgccgagcaagagacagcactgctggctacagctccaacacagccagctgtggcaagaggactctgcctgggctggcccccctcctgtgtgaggtgtctgtcccttctctgctggccagcagcagatgcactggcagctcccaaccctgtttccgcccctcggccctcccccagcctgttcggcttctctgcagcccgcaagggggagcagacttttgacaaaggactgcgggcctcgctcaagtccctgagcccccagctgaagctgggaggggaggccaggctttgtgtctgggcatattcgtctgctgatggggtttggggaagcctggggcttggggtttggtcgggtggtgcagctagtggcagagcgggatcagaggtggtggctgcccagcttctgggctgagacaagggtctgtgcaggggtttactgaagtgggagtgcctttggaatctgggccgggagcagaagggagcaaaagctacagtgggagccagcctagggcacatgggaggcgtgagggcagtgctgcccgtgcagtgtcaggtgtgccagtgccttggcgggctgcagtgcgtgtgagggcaccttctaggtgggccagggatgcagctatggagataaggcgggctggggacagaaacaggtgggcacagggcccaggacaccagcggatggagggcagggtctagccctgtgctcctgagcgtcggctgcctgggttcgaggcggtgggtccccggccccttgtgatggtgtgtaccatgggggagctcggggacagggcaagcccgagcatggtggggctgcagggtgggtctgaagccaggttgggtgggggtggtcacaagccctgactgcagagggtcaggggctcctgccccagtgcctgcccactttcaattcacattgttttcaacaaggattttctttatcttcccctacaaatcaagccaagggaggggcacagaatggggaacaggacacaggatcctaaactccaaggggactgtccaccgatgaacactcagagtggacaccatcttccgtccacgctgtgcccaggacagctgtccccatccatgaacacagggtaaacatctgccgggctccgcaccagtggctccctgggccatgggacagcggcagggctcaccacggacagcacgtggcccagcagccggccaccctggcgtcctggggcctcctcccctcctctccctctcaccttgtcacctccacggagctgcctgtctgggataatttggggattttttttctgggggataattcttttgcatgacccctaaagagcaagccacaccggtctgctagctaggtgtccgcggtgtggtggtggcggccgct

SEQ ID NO: 307523 - DNA, 3847 bp, Homo sapiens
  misc_feature (9)..(9): n is a, c, g, or t
agcggaggngtgcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagtgggcagacagaccaccgctccggccacaatgtccaccgcggcctccggcaccaccatggggctggtggaacaagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaaaaaaaaaaacaaaaaaaactaaaggaaggaaaaagctgtaaaaatcactggcattcgtggggccactccccacccaagctccacgtgtgtccgtctgtgctcctggcctctgggggaccagctgggacatgaacttgtctgccaggcccccgtcgcgtgctgaacggtgttagtttgtaggtaacgcacacaccccacacctaaggtgtctgcatcctcctgccaacgcatgggctccacgtggtgtgctcgctggctgtcgtgactgtcagctgtctcttgggaggggctgtgggggcccgctgggctggcctcctttcccgctagttgtgcctgagagttgctgttgttcctgctttcccttcccttcctttcatcccctgaagggctaggtgtgggttttccgtgcccggtatccccacacacccagcacggacaacccttcggcagagcccaggccggcccctcaccccctggagtattgaaactggagtcccgtccccaaggccttcagagatgcccctacacacccagggctccagctctggtccttctgggggagtaaagtgcaaagaggggcacagcttagttttgggcctctcgccgagcaagagacagcactgctggctacagctccaacacagccagctgtggcaagaggactctgcctgggctggcccccctcctgtgtgaggtgtctgtcccttctctgctggccagcagcagatgcactggcagctcccaaccctgtttccgcccctcggccctcccccagcctgttcggcttctctgcagcccgcaagggggagcagacttttgacaaaggactgcgggcctcgctcaagtccctgagcccccagctgaagctgggaggggaggccaggctttgtgtctgggcatattcgtctgctgatggggtttggggaagcctggggcttggggtttggtcgggtggtgcagctagtggcagagcgggatcagaggtggtggctgcccagcttctgggctgagacaagggtctgtgcaggggtttactgaagtgggagtgcctttggaatctgggccgggagcagaagggagcaaaagctacagtgggagccagcctagggcacatgggaggcgtgagggcagtgctgcccgtgcagtgtcaggtgtgccagtgccttggcgggctgcagtgcgtgtgagggcaccttctaggtgggccagggatgcagctatggagataaggcgggctggggacagaaacaggtgggcacagggcccaggacaccagcggatggagggcagggtctagccctgtgctcctgagcgtcggctgcctgggttcgaggcggtgggtccccggccccttgtgatggtgtgtaccatgggggagctcggggacagggcaagcccgagcatggtggggctgcagggtgggtctgaagccaggttgggtgggggtggtcacaagccctgactgcagagggtcaggggctcctgccccagtgcctgcccactttcaattcacattgttttcaacaaggattttctttatcttcccctacaaatcaagccaagggaggggcacagaatggggaacaggacacaggatcctaaactccaaggggactgtccaccgatgaacactcagagtggacaccatcttccgtccacgctgtgcccaggacagctgtccccatccatgaacacagggtaaacatctgccgggctccgcaccagtggagctgcgccctggtttcgccggacagagttggtgtttgggcc

SEQ ID NO: 307524 - DNA, 2672 bp, Homo sapiens
  misc_feature (9)..(9): n is a, c, g, or t
agcggaggngtgcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagtgggcagacagaccaccgctccggccacaatgtccaccgcggcctccggcaccaccatggggctggtggaacaagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaaaaaaaaaaacaaaaaaaactaaaggaaggaaaaagctgtaaaaatcactggcattcgtggggccactccccacccaagctccacgtgtgtccgtctgtgctcctggcctctgggggaccagctgggacatgaacttgtctgccaggcccccgtcgcgtgctgaacggtgttagtttgtagccaagggaggggcacagaatggggaacaggacacaggatcctaaactccaaggggactgtccaccgatgaacactcagagtggacaccatcttccgtccacgctgtgcccaggacagctgtccccatccatgaacacagggtaaacatctgccgggctccgcaccagtggctccctgggccatgggacagcggcagggctcaccacggacagcacgtggcccagcagccggccaccctggcgtcctggggcctcctcccctcctctccctctcaccttgtcacctccacggagctgcctgtctgggataatttggggattttttttctgggggataattcttttgcatgacccctaaagagcaagccacaccggtctgctagctaggtgtccgcggtgtggtggtggcggccgct

SEQ ID NO: 307525 - DNA, 2535 bp, Homo sapiens
aataaccaagaggaaacaaattctttggactattaaaaaacagaacaaactttgataaaaaataagatttccaaaagatataatttaaaaaacccttgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaaaaaaaaaaacaaaaaaaactaaaggaaggaaaaagctgtaaaaatcactggcattcgtggggccactccccacccaagctccacgtgtgtccgtctgtgctcctggcctctgggggaccagctgggacatgaacttgtctgccaggcccccgtcgcgtgctgaacggtgttagtttgtaggtaacgcacacaccccacacctaaggtgtctgcatcctcctgccaacgcatgggctccacgtggtgtgctcgctggctgtcgtgactgtcagctgtctcttgggaggggctgtgggggcccgctgggctggcctcctttcccgctagttgtgcctgagagttgctgttgttcctgctttcccttcccttcctttcatcccctgaagggctaggtgtgggttttccgtgcccggtatccccacacacccagcacggacaacccttcggcagagcccaggccggcccctcaccccctggagtattgaaactggagtcccgtccccaaggccttcagagatgcccctacacacccagggctccagctctggtccttctgggggagtaaagtgcaaagaggggcacagcttagttttgggcctctcgccgagcaagagacagcactgctggctacagctccaacacagccagctgtggcaagaggactctgcctgggctggcccccctcctgtgtgaggtgtctgtcccttctctgctggccagcagcagatgcactggcagctcccaaccctgtttccgcccctcggccctcccccagcctgttcggcttctctgcagcccgcaagggggagcagacttttgacaaaggactgcgggcctcgctcaagtccctgagcccccagctgaagctgggaggggaggccaggctttgtgtctgggcatattcgtctgctgatggggtttggggaagcctggggcttggggtttggtcgggtggtgcagctagtggcagagcgggatcagaggtggtggctgcccagcttctgggctgagacaagggtctgtgcaggggtttactgaagtgggagtgcctttggaatctgggccgggagcagaagggagcaaaagctacagtgggagccagcctagggcacatgggaggcgtgagggcagtgctgcccgtgcagtgtcaggtgtgccagtgccttggcgggctgcagtgcgtgtgagggcaccttctaggtgggccagggatgcagctatggagataaggcgggctggggacagaaacaggtgggcacagggcccaggacaccagcggatggagggcagggtctagccctgtgctcctgagcgtcggctgcctgggttcgaggcggtgggtccccggccccttgtgatggtgtgtaccatgggggagctcggggacagggcaagcccgagcatggtggggctgcagggtgggtctgaagccaggttgggtgggggtggtcacaagccctgactgcagagggtcaggggctcctgccccagtgcctgcccactttcaattcacattgttttcaacaaggattttctttatcttcccctacaaatcaagccaagggaggggcacagaatggggaacaggacacaggatcctaaactccaaggggactgtccaccgatgaacactcagagtggacaccatcttccgtccacgctgtgcccaggacagctgtccccatccatgaacacagggtaaacatctgccgggctccgcaccagtggctccctgggccatgggacagcggcagggctcaccacggacagcacgtggcccagcagccggccaccctggcgtcctggggcctcctcccctcctctccctctcaccttgtcacctccacggagctgcctgtctgggataatttggggattttttttctgggggataattcttttgcatgacccctaaagagcaagccacaccggtctgctagctaggtgtccgcggtgtggtggtggcggccgct

SEQ ID NO: 307526 - DNA, 2463 bp, Homo sapiens
cacagtcctgggcaccatgccctgtttgtgaggactgttagagccccagatgggcgttccccaggtggtgggtgcagcgggcccagagcccagttttacagggatagtagtaattgggttgggcaccttgaacctctctcccgagtgggcccttttctggactttaaccctctctgcagtgccgcatggcagacagcagagcctgggggtggatgggagagggggctgctgaggagctgacccacccgccccatttcagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaaaaaaaaaaacaaaaaaaactaaaggaaggaaaaagctgtaaaaatcactggcattcgtggggccactccccacccaagctccacgtgtgtccgtctgtgctcctggcctctgggggaccagctgggacatgaacttgtctgccaggcccccgtcgcgtgctgaacggtgttagtttgtaggtaacgcacacaccccacacctaaggtgtctgcatcctcctgccaacgcatgggctccacgtggtgtgctcgctggctgtcgtgactgtcagctgtctcttgggaggggctgtgggggcccgctgggctggcctcctttcccgctagttgtgcctgagagttgctgttgttcctgctttcccttcccttcctttcatcccctgaagggctaggtgtgggttttccgtgcccggtatccccacacacccagcacggacaacccttcggcagagcccaggccggcccctcaccccctggagtattgaaactggagtcccgtccccaaggccttcagagatgcccctacacacccagggctccagctctggtccttctgggggagtaaagtgcaaagaggggcacagcttagttttgggcctctcgccgagcaagagacagcactgctggctacagctccaacacagccagctgtggcaagaggactctgcctgggctggcccccctcctgtgtgaggtgtctgtcccttctctgctggccagcagcagatgcactggcagctcccaaccctgtttccgcccctcggccctcccccagcctgttcggcttctctgcagcccgcaagggggagcagacttttgacaaaggactgcgggcctcgctcaagtccctgagcccccagctgaagctgggaggggaggccaggctttgtgtctgggcatattcgtctgctgatggggtttggggaagcctggggcttggggtttggtcgggtggtgcagctagtggcagagcgggatcagaggtggtggctgcccagcttctgggctgagacaagggtctgtgcaggggtttactgaagtgggagtgcctttggaatctgggccgggagcagaagggagcaaaagctacagtgggagccagcctagggcacatgggaggcgtgagggcagtgctgcccgtgcagtgtcaggtgtgccagtgccttggcgggctgcagtgcgtgtgagggcaccttctaggtgggccagggatgcagctatggagataaggcgggctggggacagaaacaggtgggcacagggcccaggacaccagcggatggagggcagggtctagccctgtgctcctgagcgtcggctgcctgggttcgaggcggtgggtccccggccccttgtgatggtgtgtaccatgggggagctcggggacagggcaagcccgagcatggtggggctgcagggtgggtctgaagccaggttgggtgggggtggtcacaagccctgactgcagagggtcaggggctcctgccccagtgcctgcccactttcaattcacattgttttcaacaaggattttctttatcttcccctacaaatcaagccaagggaggggcacagaatggggaacaggacacaggatcctaaactccaaggggactgtccaccgatgaacactcagagtggacaccatcttccgtccacgctgtgcccaggacagctgtccccatccatgaacacagggtaaacatctgccgggctccgcaccagtggctccctgggccatgggacagcggcagggctcaccacggacagcacgtggcccagcagccggccaccctggcgtcctggggcctcctcccctcctctccctctcaccttgtcacctccacggagctgcctgtctgggataatttggggattttttttctgggggataattcttttgcatgacccctaaagagcaagccacaccggtctgctagctaggtgtccgcggtgtggtggtggcggccgct

SEQ ID NO: 307527 - DNA, 2186 bp, Homo sapiens
  misc_feature (9)..(9): n is a, c, g, or t
agcggaggngtgcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagccaagggaggggcacagaatggggaacaggacacaggatcctaaactccaaggggactgtccaccgatgaacactcagagtggacaccatcttccgtccacgctgtgcccaggacagctgtccccatccatgaacacagggtaaacatctgccgggctccgcaccagtggctccctgggccatgggacagcggcagggctcaccacggacagcacgtggcccagcagccggccaccctggcgtcctggggcctcctcccctcctctccctctcaccttgtcacctccacggagctgcctgtctgggataatttggggattttttttctgggggataattcttttgcatgacccctaaagagcaagccacaccggtctgctagctaggtgtccgcggtgtggtggtggcggccgct

SEQ ID NO: 307528 - DNA, 1271 bp, Homo sapiens
  misc_feature (9)..(9): n is a, c, g, or t
agcggaggngtgcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagcagccaagagtttactcaacaagaaagcaggatgatcaggacagcaggatgatcaggacagcaggatgatcaggacagcaggatgatcaggacagcaggatgatcaggac

SEQ ID NO: 307529 - DNA, 406 bp, Homo sapiens
ctgccgccttctgaagcattccaacatcggtgagcagcctggggtagggagcggggatgggtccccaccttctcccggacagcagcccattccggtttctctatcagactttcaaagagatgcagaaagacttccttttcttctctgttgaaatatcccaccagaagcccctgaggacgccccctcttctcccctgaccttgaggactttgtcgtatgtgacatgattcccgggggtgctcagagccggggcagccccaaggtggggctctgggtgcccagctccacccgactggacaggtccctttcccatcccactctgtcctttgggtcttgtcggtggcattggtgcagaggaaggtaaaggacacattcctcacagagccctctgctgagccagtgcccag

SEQ ID NO: 307530 - DNA, 251 bp, Homo sapiens
ttactcaacaagaaagcagatggagtcaaggtgaggctccagccgggccctgtggtgccggggagcccagagcctgcagcttcacccccacgccctggggctcctgctctggagtccccctccccccatgccctgagagacacgggacagggaatggcgagtgaggggcttctcccacctaagagttcctcttccctctctccacagccccagacgaatagcaccaaaaacagtgcagccgccaccagccc

SEQ ID NO: 307531 - DNA, 683 bp, Homo sapiens
gtcgagctattgtacttctacatggatgtgatcagctaccatgttttacctcattgacaagtcctgcgatgtccctcgtcgctttcgtgtcccctagtggaaaatattctcaataatgtaaaataattaaggtctatacatgggttgtatttttctggttcacaacagcacaaagtgtctttcatttttttgttggttttcttttaagatcttttttaccctgaagtcagtgaatacttttctagtttatttgatactctttctgtgtatatattaagcttttgctgtagattgcctagtaaaattactaaggataggttgtttttacatatggtctatttaagtctgatgtttacgggggaaagtgtagttactaaaaatgtttaacataatttggaagaagagtatgaacaaccaataccaatacctattgcgtttggattcttaagaccccagtttgttattccactaaactagttatcttaaccatatcatctggttttgtgggccattatttaccttcccttatgtcttatagaataatggttaatatttttaggtcaaaattacttttggaaagtaactttcccacaattaactgtttttgagcacctgacaaaatttagtgtttaccttgcgtgccattttgtgtcatccttcattaaaaaagcaattggaggttt

SEQ ID NO: 307532 - DNA, 1235 bp, Homo sapiens
cactgaatggcacgaatgccaattaggatgacagtgatgaacaggaagatgatgacagtgaggaggatgaggaggatgccgaggactagtttgaggacgtgactgcttagaaaactgcacagcatctgatgaaattagcgaataagaacatcaaccatgtcttacactccaggagttggtggtgaccccgcccagttggcccagaggatctcttctaacatccagaagatcacacagtgttctgtggaaatacaaagaactctgaatcaacttggaacacctcaagattcacctgaattgaggcaacagttgcaacagaagcagcagtatactaaccagcttgccaaagaaacagataagtacattaaagagtttggatctctgcccaccacccccagtgaacagcgtcaaaggaaaatacagaaggatcgcttagtggcagagttcacaacatcactgacaaacttccagaaggtccagaggcaggctgctgagcgagagaaagagtttgttgctcgagtaagagccagttccagagtgtctggcagttttcctgaggacagctcaaaagaaaggaatcttgtatcctgggaaagccaaactcaacctcaagtgcaggtgcaggatgaagaaattacagaggatgacctccgtcttattcatgagagagaatcttctatcaggcaacttgaagctgatattatggatattaatgaaatatttaaagatttgggaatgatgattcatgaacaaggagatgtaatagatagcatagaagccaatgtggaaaatgcagaggtgcacgttcagcaagcaaatcagcagctgtcaagggcagcagattatcagaaaaaggattcctgcatgttgatgtgaggtacaaacgccattaaagaaatctacaactgaaccaggaatgaagaacggaacaaaattcttaaccattcggttttcaatgacagcattatgattttgtttgctctgtggttttgtttgttgagattttgaatgtagtttcccattaatattaaagaatgagaatgattttggaaactcattccaaaatcattgtattttggaaacaagaaatatgtgtgaggggctgggcgtggtggctcacgcctgtaatcccagcactgtgggaggccgaagtgggcagatcatgaggtgaggagaatgggaccatcctggccaacatggtgaaactccgtctctactaaaaatacaaaaaaaaa

SEQ ID NO: 307533 - DNA, 963 bp, Homo sapiens
cacgagggccgctgtcactcagccccgcgggccaatagaaaaggggtgaaccccgccttcttcctgagttgtgctgcgggcatgcgcactgggcgtccccacgccaccgcccatcagctgagaattgcagctgagggctccggggtaggtgggtgacggcggtcggaggtgtaggagggagccgtggaggtccaggtgactgcttagaaaactgcacagcatctgatgaaattagcgaataagaacatcaaccatgtcttacactccaggagttggtggtgaccccgcccagttggcccagaggatctcttctaacatccagaagatcacacagtgttctgtggaaatacaaagaactctgaatcaacttggaacacctcaagattcacctgaattgaggcaacagttgcaacagaagcagcagtatactaaccagcttgccaaagaaacagataagtacattaaagagtttggatctctgcccaccacccccagtgaacagcgtcaaaggaaaatacagaaggatcgcttagtggcagagttcacaacatcactgacaaacttccagaaggtccagaggcaggctgctgagcgagagaaagagtttgttgctcgagtaagagccagttccagagtgtctggcagttttcctgaggacagtcaaagacaagaaattccagaggatgactccgtcttatttcatggaagagagaatctcctatcagagcaactggaaagcctgtattatggtcttcactgacctcttcacagcttggcaatgatgattcacggaacaggagatgtcttagaagcttagacgcctgtggaaatgcgaggggccgtcgaaagaaatcagaggtcggggcgagatataggcaatcagaaaccggggtaccatcttcggccgggcgcatccgcccaagtggtgcccgagttaagaccgtgccacggtattgagaccgc

SEQ ID NO: 307534 - DNA, 386 bp, Homo sapiens
aatctctctatccttaatctctctatccttaatcctctatccttaatctcctatcttaatctctctatccttaatctctctatccttaacctctctatcctcaatctctcaatcctcaatctctctatccttaatctctctatccttaatctctctatccttaatctctctatccttaatctctctatccttaatctctctatccttaatccggggtaggtgggtgacggcggtcggaggtgtaggagggagccgtggaggtccaggtgactgcttagaaaactgcacagcatctgatgaaattagcgaataagaacattttagctattgttattttttttcagctgtgggtagtgatggtggtgttttgaagattaaggatagag

SEQ ID NO: 307535 - DNA, 3875 bp, Homo sapiens
cacgagggccgctgtcactcagccccgcgggccaatagaaaaggggtgaaccccgccttcttcctgagttgtgctgcgggcatgcgcactgggcgtccccacgccaccgcccatcagctgagaattgcagctgagggctccggggtaggtgggtgacggcggtcggaggtgtaggagggagccgtggaggtccaggtgactgcttagaaaactgcacagcatctgatgaaattagcgaataagaacatcaaccatgtcttacactccaggagttggtggtgaccccgcccagttggcccagaggatctcttctaacatccagaagatcacacagtgttctgtggaaatacaaagaactctgaatcaacttggaacacctcaagattcacctgaattgaggcaacagttgcaacagaagcagcagtatactaaccagcttgccaaagaaacagataagtacattaaagagtttggatctctgcccaccacccccagtgaacagcgtcaaaggaaaatacagaaggatcgcttagtggcagagttcacaacatcactgacaaacttccagaaggtccagaggcaggctgctgagcgagagaaagagtttgttgctcgagtaagagccagttccagagtgtctggcagttttcctgaggacagctcaaaagaaaggaatcttgtatcctgggaaagccaaactcaacctcaagtgcaggtgcaggatgaagaaattacagaggatgacctccgtcttattcatgagagagaatcttctatcaggcaacttgaagctgatattatggatattaatgaaatatttaaagatttgggaatgatgattcatgaacaaggagatgtaatagatagcatagaagccaatgtggaaaatgcagaggtgcacgttcagcaagcaaatcagcagctgtcaagggcagcagattatcagcgcaaatccagaaaaaccctgtgcatcatcattcttatccttgtcattggagttgcgattatcagtctcatcatatggggattgaaccactgaagttataaaggagcacactgtcgcactacattgtctaaattatgtaggaagattcctgtaatcatgtttttttaattattattttaaagctattgtataaaggatggttcccatactttgttatttttattgggggggttggggtggttcctttggattaaatctgatattttctaatactgaaagattttctaaatgtcactgctgacataactcccttggtcttcaatttaatagttgttaagtttttgcccacattgcatatgcctttcatttataatttatttaccctgcttgacttagttttgggaattcgtaaatttaaaggtgtgtgtattctgtttgcatctccctgtcactgtgacacacctagatgtgtgttacttcaattaaaattctcaaatttaattttgatttgcttcagcagggaaaatattctcaataatgtaaaataattaaggtctatacatgggttgtatttttctggttcacaacagcacaaagtgtctttcatttttttgttggttttcttttaagatcttttttaccctgaagtcagtgaatacttttctagtttatttgatactctttctgtgtatatattaagcttttgctgtagattgcctagtaaaattactaaggataggttgtttttacatatggtctatttaagtctgatgtttacgggggaaagtgtagttactaaaaatgtttaacataatttggaagaagagtatgaacaaccaataccaatacctattgcgtttggattcttaagaccccagtttgttattccactaaactagttatcttaaccatatcatctggttttgtgggccattatttaccttcccttatgtcttatagaataatggttaatatttttaggtcaaaattacttttggaaagtaactttcccacaattaactgtttttgagcacctgacaaaatttagtgtttaccttgcgtgccattttgtgtcatccttcattaaaaaagcaattggaggtttgccagttatctcacttccctttttaaatcaatgttgttttaatgcactaatctgaattctgtaaagaggattatcttagtttatactttgtattttataatgttcttgtatagcagttcggtactgaaggcggtgtttaacttggcaagctctgagacttcaaatgggaacaaatagtaagtagctaagtaaaccacatctttgcaaccaaaataaagatgagttaaaaggtatctggttaggcctatttcatgaggactatgctctggtgggaccacaggtcacctgatacttagtgctgtgctgcctgaaacctcagcatggagacatcaccacatgcactgtggccattcagcatctttctggagcaccagttcactccaggtttttattttagggtgtcatcgattttacctactttgtcagactggtagaagttgctttgcatatcagaaaaactccatttttttccacaaaagggattacagaaaactcttttgtgagtgagtgattggaacttagagactcctgttgccagaatcagactgccctagaacagaatggacaatgcagggaggagaattcacacaaacagcacctgttctgaggcctgtgccagcccaccaggcctgctcaaatgtggtctttacttcaagtgcacagaggcacatgaggtttctggtgataaaccagcgtcttaccgctgttttaaagtcccatccccatggctttcacaatcagttccgttttttttgctgtacttgataaaatgtttattctcatacaggtcaagtacatttacttctattcacagtgagtacccaataacaacaaaagcgcttacaaatttggggggcgtgattttagtacctttatttgaagtgtaatcattttaaattattattattttaactggggcagttatcagtggtttaaacaggaactttagtggcttcaattcgtttaagaaacatattaagtttgagggaaaaatttcccatgaaatatttggaacgtaagagtagtattgattagagaaaattaaataagaaacatagtatggtagccaaattttttaaaaaatcttgaacttttctgtaggtcagttttagaactgctgtgaaaagtgaaggttgccctgtggagattaaaattagagttgttttcataactgacagcatggtgaatccatttgagtcaaagtgaagaatttcctcatcaagtgactatacatttgtttttgtgtgctcaaaagaaatactcaaacacagactgatattaaccagccaggtaaattgaacgacaatgtggcattaggtatttggctgtttattggtcgttaaatactatggttttgcaatatgattgatggtaaaagagtgatgtcatattgatactagagtagcttgtttttttagtaggtgtgggaccatctcttttacaagtgcaactcagtctaggacagccatggatgcagtgtctggagttggaccctctgagcccgctggctgccccagtagcatctgcattggtgaccaaggacactgcactttgaagaggtcgccactgggttatttagtgtcttcactgcttttgttaaaaattgtaaaattttgtacacaaaaagttgtgtttttgaatatcaattgtttagacacacctacaatgataaataagtgcctttaaaggcccctctttccatgaaatacatctgtggtttagcaaggaaagtacaaaatagtttatgtagttggtataatttttatttgtgtcttcatgtagaaaaaatgaatgtcataataaaatataaaacttacgtaaaga

SEQ ID NO: 307536 - DNA, 6318 bp, Homo sapiens
  misc_feature (4787)..(4787): n is a, c, g, or t
cacgagggccgctgtcactcagccccgcgggccaatagaaaaggggtgaaccccgccttcttcctgagttgtgctgcgggcatgcgcactgggcgtccccacgccaccgcccatcagctgagaattgcagctgagggctccggggtaggtgggtgacggcggtcggaggtgtaggagggagccgtggaggtccaggtgactgcttagaaaactgcacagcatctgatgaaattagcgaataagaacatcaaccatgtcttacactccaggagttggtggtgaccccgcccagttggcccagaggatctcttctaacatccagaagatcacacagtgttctgtggaaatacaaagaactctgaatcaacttggaacacctcaagattcacctgaattgaggcaacagttgcaacagaagcagcagtatactaaccagcttgccaaagaaacagataagtacattaaagagtttggatctctgcccaccacccccagtgaacagcgtcaaaggaaaatacagaaggatcgcttagtggcagagttcacaacatcactgacaaacttccagaaggtccagaggcaggctgctgagcgagagaaagagtttgttgctcgagtaagagccagttccagagtgtctggcagttttcctgaggacagctcaaaagaaaggaatcttgtatcctgggaaagccaaactcaacctcaagtgcaggtgcaggatgaagaaattacagaggatgacctccgtcttattcatgagagagaatcttctatcaggcaacttgaagctgatattatggatattaatgaaatatttaaagatttgggaatgatgattcatgaacaaggagatgtaatagatagcatagaagccaatgtggaaaatgcagaggtgcacgttcagcaagcaaatcagcagctgtcaagggcagcagattatcagcgcaaatccagaaaaaccctgtgcatcatcattcttatccttgtcattggagttgcgattatcagtctcatcatatggggattgaaccactgaagttataaaggagcacactgtcgcactacattgtctaaattatgtaggaagattcctgtaatcatgtttttttaattattattttaaagctattgtataaaggatggttcccatactttgttatttttattgggggggttggggtggttcctttggattaaatctgatattttctaatactgaaagattttctaaatgtcactgctgacataactcccttggtcttcaatttaatagttgttaagtttttgcccacattgcatatgcctttcatttataatttatttaccctgcttgacttagttttgggaattcgtaaatttaaaggtgtgtgtattctgtttgcatctccctgtcactgtgacacacctagatgtgtgttacttcaattaaaattctcaaatttaattttgatttgcttcagcagggaaaatattctcaataatgtaaaataattaaggtctatacatgggttgtatttttctggttcacaacagcacaaagtgtctttcatttttttgttggttttcttttaagatcttttttaccctgaagtcagtgaatacttttctagtttatttgatactctttctgtgtatatattaagcttttgctgtagattgcctagtaaaattactaaggataggttgtttttacatatggtctatttaagtctgatgtttacgggggaaagtgtagttactaaaaatgtttaacataatttggaagaagagtatgaacaaccaataccaatacctattgcgtttggattcttaagaccccagtttgttattccactaaactagttatcttaaccatatcatctggttttgtgggccattatttaccttcccttatgtcttatagaataatggttaatatttttaggtcaaaattacttttggaaagtaactttcccacaattaactgtttttgagcacctgacaaaatttagtgtttaccttgcgtgccattttgtgtcatccttcattaaaaaagcaattggaggtttgccagttatctcacttccctttttaaatcaatgttgttttaatgcactaatctgaattctgtaaagaggattatcttagtttatactttgtattttataatgttcttgtatagcagttcggtactgaaggcggtgtttaacttggcaagctctgagacttcaaatgggaacaaatagtaagtagctaagtaaaccacatctttgcaaccaaaataaagatgagttaaaaggtatctggttaggcctatttcatgaggactatgctctggtgggaccacaggtcacctgatacttagtgctgtgctgcctgaaacctcagcatggagacatcaccacatgcactgtggccattcagcatctttctggagcaccagttcactccaggtttttattttagggtgtcatcgattttacctactttgtcagactggtagaagttgctttgcatatcagaaaaactccatttttttccacaaaagggattacagaaaactcttttgtgagtgagtgattggaacttagagactcctgttgccagaatcagactgccctagaacagaatggacaatgcagggaggagaattcacacaaacagcacctgttctgaggcctgtgccagcccaccaggcctgctcaaatgtggtctttacttcaagtgcacagaggcacatgaggtttctggtgataaaccagcgtcttaccgctgttttaaagtcccatccccatggctttcacaatcagttccgttttttttgctgtacttgataaaatgtttattctcatacaggtcaagtacatttacttctattcacagtgagtacccaataacaacaaaagcgcttacaaatttggggggcgtgattttagtacctttatttgaagtgtaatcattttaaattattattattttaactggggcagttatcagtggtttaaacaggaactttagtggcttcaattcgtttaagaaacatattaagtttgagggaaaaatttcccatgaaatatttggaacgtaagagtagtattgattagagaaaattaaataagaaacatagtatggtagccaaattttttaaaaaatcttgaacttttctgtaggtcagttttagaactgctgtgaaaagtgaaggttgccctgtggagattaaaattagagttgttttcataactgacagcatggtgaatccatttgagtcaaagtgaagaatttcctcatcaagtgactatacatttgtttttgtgtgctcaaaagaaatactcaaacacagactgatattaaccagccaggtaaattgaacgacaatgtggcattaggtatttggctgtttattggtcgttaaatactatggttttgcaatatgattgatggtaaaagagtgatgtcatattgatactagagtagcttgtttttttagtaggtgtgggaccatctcttttacaagtgcaactcagtctaggacagccatggatgcagtgtctggagttggaccctctgagcccgctggctgccccagtagcatctgcattggtgaccaaggacactgcactttgaagaggtcgccactgggttatttagtgtcttcactgcttttgttaaaaattgtaaaattttgtacacaaaaagttgtgtttttgaatatcaattgtttagacacacctacaatgataaataagtgcctttaaaggcccctctttccatgaaatacatctgtggtttagcaaggaaagtacaaaatagtttatgtagttggtataatttttatttgtgtcttcatgtagaaaaaatgaatgtcataataaaatataaaacttacgtaaagaaaataaagtcattgtccaccttaatagctaaggtccacaagggtaacttatgcagcatttattttttttgaaagtcaaaattgaatttatttctttcacatggctggtttgctgcaatatgaagtttcagaatgggctgaagtaagttgattgagggatttgagttgaatgacattttcaagttcatttaaatatgataaaaattcattggtggtaaataacatctgtctttcctggaaaaaaaaaagttgtgtattttcatgattcagttaaaacaaaaaatgagcctgtgaatcccaggcctttttagtcctccataacatttgaacagtttgacttgtcagcaaagaaatacacttatcaaattttaaaccaatgggagcctgaaagtgttacagtgtactgcttctttgacaaaattctgtttaacaactaccctaacataatttataaatcaattaagataaaaccatttttttctgagtatttaggaatttgtgtcctcaaaatactgtgacatgaaagataggaaagaaattacctggttgccagacatgcacgattatctttcctcatttcagctggattttccaaagtcagtagattggataaagcagcatctcattcactgaggtcacaagataggtaggaaacttctttaatgtgaattttgcatattttaacaattcagttagaaaaacagaaaccacttgatggattataagtgtaaagtgttttaacatagggaattagacatcaaaagggtgggtgaggaaggtgtctgcggccccaaagtgggtggatctcaggagctggcccaggcactgctgtgactcttgagaacatccagaaggctgtgctgttggcgtgcagcactgacagtgtgtctcagggagctgtccccagctgtcngctgttaatagctccaaagccagtgccttgcaagagattttgaaactgctgtgaaactcatgtcctctgcccgcctacacttctgtctgcagtggcctctgaggaaagatggtctctccttttctcatggtcaactctcaacttagaaccagagacagaaggagtttgtgggaagtgtggtttctggtctacctgcactgcagaggacattctagaaagagaagtgagttgacagtctagcataattgtgaaacaaacactgagatgtacagttcaaaccacgtgaagtggaagcctcagaattttcctcactttcattaaagattctttgatggaaaaatttagaagcattggctctagatggtaagcaagtcatttttttccaaccaaaataaaaaatacatatactaagcttctggggccccaggacttaacacagtttccttccttccttcccttcttccttccctcccgtagtagttgcttaataaatacttaatttggcacttatttggggccggctttttgccaggctactacatgcctgggcatagtgttctaagagtgaaccaaaagaataagcttcctgccctcagggagtttatgttttgttatttggcatataaaaagaacttggtgtgttaaaagaagggaaatagctgtgtgaaaggaatgaggcaaggaaaaaggggaatgtctaaatataaatctccgtttggaccagcctcctgtttatccagttttccttactaagtaactgaatttcattttcttttcttaattgacagactaccagaaaattgctagttttctaaagagaaactactgatttgagtgatgatctgtgtgtaatggctccaaaaaggagccgttctcttggtggcagcagttggattcagagcttgggcatcctgatcatcaggacagacatttacaggatatgtatagaattactgccccaaatagagggcaaagcactagacagaagggtgagatccaaggggaatttggaatctatatttcatcagaatgcactcaaagcaaaaacagtaagtatgctccatataaagaaatgtttcttaaaatgtttttaatttaaccctacccatcccttggcaaatctttttcttttaaatcaaataggaataaagaagaaaatcttcctaaaggcccattttctcattattcaaataccatatcaatacaccaattttaattctttgtttttgtaatcatttggttaacatgaatattatgtaatatttttctccaaataatcctaattttaaatgcagaaatagagctaaataacacactaaataggtttttgtagacactgtagcttctggcaagtttttaagaggttggtcacttaattgcttagagtgggattcccgtaggttttgtgtagtgatggcatttatgcttaaaatgtaagtggtggaaggcaaaaccagatttcctgtccagtcgttacacgcacaacacctctacttgttgacgagggagttttctagaactgaattgaatc

SEQ ID NO: 307537 - DNA, 5263 bp, Homo sapiens
cacgagggccgctgtcactcagccccgcgggccaatagaaaaggggtgaaccccgccttcttcctgagttgtgctgcgggcatgcgcactgggcgtccccacgccaccgcccatcagctgagaattgcagctgagggctccggggtaggtgggtgacggcggtcggaggtgtaggagggagccgtggaggtccaggtgactgcttagaaaactgcacagcatctgatgaaattagcgaataagaacatcaaccatgtcttacactccaggagttggtggtgaccccgcccagttggcccagaggatctcttctaacatccagaagatcacacagtgttctgtggaaatacaaagaactctgaatcaacttggaacacctcaagattcacctgaattgaggcaacagttgcaacagaagcagcagtatactaaccagcttgccaaagaaacagataagtacattaaagagtttggatctctgcccaccacccccagtgaacagcgtcaaaggaaaatacagaaggatcgcttagtggcagagttcacaacatcactgacaaacttccagaaggtccagaggcaggctgctgagcgagagaaagagtttgttgctcgagtaagagccagttccagagtgtctggcagttttcctgaggacagctcaaaagaaaggaatcttgtatcctgggaaagccaaactcaacctcaagtgcaggtgcaggatgaagaaattacagaggatgacctccgtcttattcatgagagagaatcttctatcaggcaacttgaagctgatattatggatattaatgaaatatttaaagatttgggaatgatgattcatgaacaaggagatgtaatagatagcatagaagccaatgtggaaaatgcagaggtgcacgttcagcaagcaaatcagcagctgtcaagggcagcagattatcagcgcaaatccagaaaaaccctgtgcatcatcattcttatccttgtcattggagttgcgattatcagtctcatcatatggggattgaaccactgaagttataaaggagcacactgtcgcactacattgtctaaattatgtaggaagattcctgtaatcatgtttttttaattattattttaaagctattgtataaaggatggttcccatactttgttatttttattgggggggttggggtggttcctttggattaaatctgatattttctaatactgaaagattttctaaatgtcactgctgacataactcccttggtcttcaatttaatagttgttaagtttttgcccacattgcatatgcctttcatttataatttatttaccctgcttgacttagttttgggaattcgtaaatttaaaggtgtgtgtattctgtttgcatctccctgtcactgtgacacacctagatgtgtgttacttcaattaaaattctcaaatttaattttgatttgcttcagcagggaaaatattctcaataatgtaaaataattaaggtctatacatgggttgtatttttctggttcacaacagcacaaagtgtctttcatttttttgttggttttcttttaagatcttttttaccctgaagtcagtgaatacttttctagtttatttgatactctttctgtgtatatattaagcttttgctgtagattgcctagtaaaattactaaggataggttgtttttacatatggtctatttaagtctgatgtttacgggggaaagtgtagttactaaaaatgtttaacataatttggaagaagagtatgaacaaccaataccaatacctattgcgtttggattcttaagaccccagtttgttattccactaaactagttatcttaaccatatcatctggttttgtgggccattatttaccttcccttatgtcttatagaataatggttaatatttttaggtcaaaattacttttggaaagtaactttcccacaattaactgtttttgagcacctgacaaaatttagtgtttaccttgcgtgccattttgtgtcatccttcattaaaaaagcaattggaggtttgccagttatctcacttccctttttaaatcaatgttgttttaatgcactaatctgaattctgtaaagaggattatcttagtttatactttgtattttataatgttcttgtatagcagttcggtactgaaggcggtgtttaacttggcaagctctgagacttcaaatgggaacaaatagtaagtagctaagtaaaccacatctttgcaaccaaaataaagatgagttaaaaggtatctggttaggcctatttcatgaggactatgctctggtgggaccacaggtcacctgatacttagtgctgtgctgcctgaaacctcagcatggagacatcaccacatgcactgtggccattcagcatctttctggagcaccagttcactccaggtttttattttagggtgtcatcgattttacctactttgtcagactggtagaagttgctttgcatatcagaaaaactccatttttttccacaaaagggattacagaaaactcttttgtgagtgagtgattggaacttagagactcctgttgccagaatcagactgccctagaacagaatggacaatgcagggaggagaattcacacaaacagcacctgttctgaggcctgtgccagcccaccaggcctgctcaaatgtggtctttacttcaagtgcacagaggcacatgaggtttctggtgataaaccagcgtcttaccgctgttttaaagtcccatccccatggctttcacaatcagttccgttttttttgctgtacttgataaaatgtttattctcatacaggtcaagtacatttacttctattcacagtgagtacccaataacaacaaaagcgcttacaaatttggggggcgtgattttagtacctttatttgaagtgtaatcattttaaattattattattttaactggggcagttatcagtggtttaaacaggaactttagtggcttcaattcgtttaagaaacatattaagtttgagggaaaaatttcccatgaaatatttggaacgtaagagtagtattgattagagaaaattaaataagaaacatagtatggtagccaaattttttaaaaaatcttgaacttttctgtaggtcagttttagaactgctgtgaaaagtgaaggttgccctgtggagattaaaattagagttgttttcataactgacagcatggtgaatccatttgagtcaaagtgaagaatttcctcatcaagtgactatacatttgtttttgtgtgctcaaaagaaatactcaaacacagactgatattaaccagccaggtaaattgaacgacaatgtggcattaggtatttggctgtttattggtcgttaaatactatggttttgcaatatgattgatggtaaaagagtgatgtcatattgatactagagtagcttgtttttttagtaggtgtgggaccatctcttttacaagtgcaactcagtctaggacagccatggatgcagtgtctggagttggaccctctgagcccgctggctgccccagtagcatctgcattggtgaccaaggacactgcactttgaagaggtcgccactgggttatttagtgtcttcactgcttttgttaaaaattgtaaaattttgtacacaaaaagttgtgtttttgaatatcaattgtttagacacacctacaatgataaataagtgcctttaaaggcccctctttccatgaaatacatctgtggtttagcaaggaaagtacaaaatagtttatgtagttggtataatttttatttgtgtcttcatgtagaaaaaatgaatgtcataataaaatataaaacttacgtaaagaaaataaagtcattgtccaccttaatagctaaggtccacaagggtaacttatgcagcatttattttttttgaaagtcaaaattgaatttatttctttcacatggctggtttgctgcaatatgaagtttcagaatgggctgaagtaagttgattgagggatttgagttgaatgacattttcaagttcatttaaatatgataaaaattcattggtggtaaataacatctgtctttcctggaaaaaaaaaagttgtgtattttcatgattcagttaaaacaaaaaatgagcctgtgaatcccaggcctttttagtcctccataacatttgaacagtttgacttgtcagcaaagaaatacacttatcaaattttaaaccaatgggagcctgaaagtgttacagtgtactgcttctttgacaaaattctgtttaacaactaccctaacataatttataaatcaattaagataaaaccatttttttctgagtatttaggaatttgtgtcctcaaaatactgtgacatgaaagataggaaagaaattacctggttgccagacatgcacgattatctttcctcatttcagctggattttccaaagtcagtagattggataaagcagcatctcattcactgaggtcacaagatagactaccagaaaattgctagttttctaaagagaaactactgatttgagtgatgatctgtgtgtaatggctccaaaaaggagccgttctcttggtggcagcagttggattcagagcttgggcatcctgatcatcaggacagacatttacaggatatgtatagaattactgccccaaatagagggcaaagcactagacagaagggtgagatccaaggggaatttggaatctatatttcatcagaatgcactcaaagcaaaaacagtaagtatgctccatataaagaaatgtttcttaaaatgtttttaatttaaccctacccatcccttggcaaatctttttcttttaaatcaaataggaataaagaagaaaatcttcctaaaggcccattttctcattattcaaataccatatcaatacaccaattttaattctttgtttttgtaatcatttggttaacatgaatattatgtaatatttttctccaaataatcctaattttaaatgcagaaatagagctaaataacacactaaataggtttttgtagacactgtagcttctggcaagtttttaagaggttggtcacttaattgcttagagtgggattcccgtaggttttgtgtagtgatggcatttatgcttaaaatgtaagtggtggaaggcaaaaccagatttcctgtccagtcgttacacgcacaacacctctacttgttgacgagggagttttctagaactgaattgaatc

SEQ ID NO: 307538 - DNA, 3820 bp, Homo sapiens
cacgagggccgctgtcactcagccccgcgggccaatagaaaaggggtgaaccccgccttcttcctgagttgtgctgcgggcatgcgcactgggcgtccccacgccaccgcccatcagctgagaattgcagctgagggctccggggtaggtgggtgacggcggtcggaggtgtaggagggagccgtggaggtccaggtgactgcttagaaaactgcacagcatctgatgaaattagcgaataagaacatcaaccatgtcttacactccaggagttggtggtgaccccgcccagttggcccagaggatctcttctaacatccagaagatcacacagtgttctgtggaaatacaaagaactctgaatcaacttggaacacctcaagattcacctgaattgaggcaacagttgcaacagaagcagcagtatactaaccagcttgccaaagaaacagataagtacattaaagagtttggatctctgcccaccacccccagtgaacagcgtcaaaggaaaatacagaaggatcgcttagtggcagagttcacaacatcactgacaaacttccagaaggtccagaggcaggctgctgagcgagagaaagagtttgttgctcgagtaagagccagttccagagtgtctggcagttttcctgaggacagctcaaaagaaaggaatcttgtatcctgggaaagccaaactcaacctcaagtgcaggtgcaggatgaagaaattacagaggatgacctccgtcttattcatgagagagaatcttctatcaggcaacttgaagctgatattatggatattaatgaaatatttaaagatttgggaatgatgattcatgaacaaggagatgtaatagatagcatagaagccaatgtggaaaatgcagaggtgcacgttcagcaagcaaatcagcagctgtcaagggcagcagattatcagcgattatcagtctcatcatatggggattgaaccactgaagttataaaggagcacactgtcgcactacattgtctaaattatgtaggaagattcctgtaatcatgtttttttaattattattttaaagctattgtataaaggatggttcccatactttgttatttttattgggggggttggggtggttcctttggattaaatctgatattttctaatactgaaagattttctaaatgtcactgctgacataactcccttggtcttcaatttaatagttgttaagtttttgcccacattgcatatgcctttcatttataatttatttaccctgcttgacttagttttgggaattcgtaaatttaaaggtgtgtgtattctgtttgcatctccctgtcactgtgacacacctagatgtgtgttacttcaattaaaattctcaaatttaattttgatttgcttcagcagggaaaatattctcaataatgtaaaataattaaggtctatacatgggttgtatttttctggttcacaacagcacaaagtgtctttcatttttttgttggttttcttttaagatcttttttaccctgaagtcagtgaatacttttctagtttatttgatactctttctgtgtatatattaagcttttgctgtagattgcctagtaaaattactaaggataggttgtttttacatatggtctatttaagtctgatgtttacgggggaaagtgtagttactaaaaatgtttaacataatttggaagaagagtatgaacaaccaataccaatacctattgcgtttggattcttaagaccccagtttgttattccactaaactagttatcttaaccatatcatctggttttgtgggccattatttaccttcccttatgtcttatagaataatggttaatatttttaggtcaaaattacttttggaaagtaactttcccacaattaactgtttttgagcacctgacaaaatttagtgtttaccttgcgtgccattttgtgtcatccttcattaaaaaagcaattggaggtttgccagttatctcacttccctttttaaatcaatgttgttttaatgcactaatctgaattctgtaaagaggattatcttagtttatactttgtattttataatgttcttgtatagcagttcggtactgaaggcggtgtttaacttggcaagctctgagacttcaaatgggaacaaatagtaagtagctaagtaaaccacatctttgcaaccaaaataaagatgagttaaaaggtatctggttaggcctatttcatgaggactatgctctggtgggaccacaggtcacctgatacttagtgctgtgctgcctgaaacctcagcatggagacatcaccacatgcactgtggccattcagcatctttctggagcaccagttcactccaggtttttattttagggtgtcatcgattttacctactttgtcagactggtagaagttgctttgcatatcagaaaaactccatttttttccacaaaagggattacagaaaactcttttgtgagtgagtgattggaacttagagactcctgttgccagaatcagactgccctagaacagaatggacaatgcagggaggagaattcacacaaacagcacctgttctgaggcctgtgccagcccaccaggcctgctcaaatgtggtctttacttcaagtgcacagaggcacatgaggtttctggtgataaaccagcgtcttaccgctgttttaaagtcccatccccatggctttcacaatcagttccgttttttttgctgtacttgataaaatgtttattctcatacaggtcaagtacatttacttctattcacagtgagtacccaataacaacaaaagcgcttacaaatttggggggcgtgattttagtacctttatttgaagtgtaatcattttaaattattattattttaactggggcagttatcagtggtttaaacaggaactttagtggcttcaattcgtttaagaaacatattaagtttgagggaaaaatttcccatgaaatatttggaacgtaagagtagtattgattagagaaaattaaataagaaacatagtatggtagccaaattttttaaaaaatcttgaacttttctgtaggtcagttttagaactgctgtgaaaagtgaaggttgccctgtggagattaaaattagagttgttttcataactgacagcatggtgaatccatttgagtcaaagtgaagaatttcctcatcaagtgactatacatttgtttttgtgtgctcaaaagaaatactcaaacacagactgatattaaccagccaggtaaattgaacgacaatgtggcattaggtatttggctgtttattggtcgttaaatactatggttttgcaatatgattgatggtaaaagagtgatgtcatattgatactagagtagcttgtttttttagtaggtgtgggaccatctcttttacaagtgcaactcagtctaggacagccatggatgcagtgtctggagttggaccctctgagcccgctggctgccccagtagcatctgcattggtgaccaaggacactgcactttgaagaggtcgccactgggttatttagtgtcttcactgcttttgttaaaaattgtaaaattttgtacacaaaaagttgtgtttttgaatatcaattgtttagacacacctacaatgataaataagtgcctttaaaggcccctctttccatgaaatacatctgtggtttagcaaggaaagtacaaaatagtttatgtagttggtataatttttatttgtgtcttcatgtagaaaaaatgaatgtcataataaaatataaaacttacgtaaaga

SEQ ID NO: 307539 - DNA, 3778 bp, Homo sapiens
cactgaatggcacgaatgccaattaggatgacagtgatgaacaggaagatgatgacagtgaggaggatgaggaggatgccgaggactagtttgaggacgtgactgcttagaaaactgcacagcatctgatgaaattagcgaataagaacatcaaccatgtcttacactccaggagttggtggtgaccccgcccagttggcccagaggatctcttctaacatccagaagatcacacagtgttctgtggaaatacaaagaactctgaatcaacttggaacacctcaagattcacctgaattgaggcaacagttgcaacagaagcagcagtatactaaccagcttgccaaagaaacagataagtacattaaagagtttggatctctgcccaccacccccagtgaacagcgtcaaaggaaaatacagaaggatcgcttagtggcagagttcacaacatcactgacaaacttccagaaggtccagaggcaggctgctgagcgagagaaagagtttgttgctcgagtaagagccagttccagagtgtctggcagttttcctgaggacagctcaaaagaaaggaatcttgtatcctgggaaagccaaactcaacctcaagtgcaggtgcaggatgaagaaattacagaggatgacctccgtcttattcatgagagagaatcttctatcaggcaacttgaagctgatattatggatattaatgaaatatttaaagatttgggaatgatgattcatgaacaaggagatgtaatagatagcatagaagccaatgtggaaaatgcagaggtgcacgttcagcaagcaaatcagcagctgtcaagggcagcagattatcagcgcaaatccagaaaaaccctgtgcatcatcattcttatccttgtcattggagttgcgattatcagtctcatcatatggggattgaaccactgaagttataaaggagcacactgtcgcactacattgtctaaattatgtaggaagattcctgtaatcatgtttttttaattattattttaaagctattgtataaaggatggttcccatactttgttatttttattgggggggttggggtggttcctttggattaaatctgatattttctaatactgaaagattttctaaatgtcactgctgacataactcccttggtcttcaatttaatagttgttaagtttttgcccacattgcatatgcctttcatttataatttatttaccctgcttgacttagttttgggaattcgtaaatttaaaggtgtgtgtattctgtttgcatctccctgtcactgtgacacacctagatgtgtgttacttcaattaaaattctcaaatttaattttgatttgcttcagcagggaaaatattctcaataatgtaaaataattaaggtctatacatgggttgtatttttctggttcacaacagcacaaagtgtctttcatttttttgttggttttcttttaagatcttttttaccctgaagtcagtgaatacttttctagtttatttgatactctttctgtgtatatattaagcttttgctgtagattgcctagtaaaattactaaggataggttgtttttacatatggtctatttaagtctgatgtttacgggggaaagtgtagttactaaaaatgtttaacataatttggaagaagagtatgaacaaccaataccaatacctattgcgtttggattcttaagaccccagtttgttattccactaaactagttatcttaaccatatcatctggttttgtgggccattatttaccttcccttatgtcttatagaataatggttaatatttttaggtcaaaattacttttggaaagtaactttcccacaattaactgtttttgagcacctgacaaaatttagtgtttaccttgcgtgccattttgtgtcatccttcattaaaaaagcaattggaggtttgccagttatctcacttccctttttaaatcaatgttgttttaatgcactaatctgaattctgtaaagaggattatcttagtttatactttgtattttataatgttcttgtatagcagttcggtactgaaggcggtgtttaacttggcaagctctgagacttcaaatgggaacaaatagtaagtagctaagtaaaccacatctttgcaaccaaaataaagatgagttaaaaggtatctggttaggcctatttcatgaggactatgctctggtgggaccacaggtcacctgatacttagtgctgtgctgcctgaaacctcagcatggagacatcaccacatgcactgtggccattcagcatctttctggagcaccagttcactccaggtttttattttagggtgtcatcgattttacctactttgtcagactggtagaagttgctttgcatatcagaaaaactccatttttttccacaaaagggattacagaaaactcttttgtgagtgagtgattggaacttagagactcctgttgccagaatcagactgccctagaacagaatggacaatgcagggaggagaattcacacaaacagcacctgttctgaggcctgtgccagcccaccaggcctgctcaaatgtggtctttacttcaagtgcacagaggcacatgaggtttctggtgataaaccagcgtcttaccgctgttttaaagtcccatccccatggctttcacaatcagttccgttttttttgctgtacttgataaaatgtttattctcatacaggtcaagtacatttacttctattcacagtgagtacccaataacaacaaaagcgcttacaaatttggggggcgtgattttagtacctttatttgaagtgtaatcattttaaattattattattttaactggggcagttatcagtggtttaaacaggaactttagtggcttcaattcgtttaagaaacatattaagtttgagggaaaaatttcccatgaaatatttggaacgtaagagtagtattgattagagaaaattaaataagaaacatagtatggtagccaaattttttaaaaaatcttgaacttttctgtaggtcagttttagaactgctgtgaaaagtgaaggttgccctgtggagattaaaattagagttgttttcataactgacagcatggtgaatccatttgagtcaaagtgaagaatttcctcatcaagtgactatacatttgtttttgtgtgctcaaaagaaatactcaaacacagactgatattaaccagccaggtaaattgaacgacaatgtggcattaggtatttggctgtttattggtcgttaaatactatggttttgcaatatgattgatggtaaaagagtgatgtcatattgatactagagtagcttgtttttttagtaggtgtgggaccatctcttttacaagtgcaactcagtctaggacagccatggatgcagtgtctggagttggaccctctgagcccgctggctgccccagtagcatctgcattggtgaccaaggacactgcactttgaagaggtcgccactgggttatttagtgtcttcactgcttttgttaaaaattgtaaaattttgtacacaaaaagttgtgtttttgaatatcaattgtttagacacacctacaatgataaataagtgcctttaaaggcccctctttccatgaaatacatctgtggtttagcaaggaaagtacaaaatagtttatgtagttggtataatttttatttgtgtcttcatgtagaaaaaatgaatgtcataataaaatataaaacttacgtaaaga

SEQ ID NO: 307540 - DNA, 3505 bp, Homo sapiens
gcgcgcgtcgacccggccgcctcgacacggtgcgagaagcaacagaagcagcagtatactaaccagcttgccaaagaaacagataagtacattaaagagtttggatctctgcccaccacccccagtgaacagcgtcaaaggaaaatacagaaggatcgcttagtggcagagttcacaacatcactgacaaacttccagaaggtccagaggcaggctgctgagcgagagaaagagtttgttgctcgagtaagagccagttccagagtgtctggcagttttcctgaggacagctcaaaagaaaggaatcttgtatcctgggaaagccaaactcaacctcaagtgcaggtgcaggatgaagaaattacagaggatgacctccgtcttattcatgagagagaatcttctatcaggcaacttgaagctgatattatggatattaatgaaatatttaaagatttgggaatgatgattcatgaacaaggagatgtaatagatagcatagaagccaatgtggaaaatgcagaggtgcacgttcagcaagcaaatcagcagctgtcaagggcagcagattatcagcgcaaatccagaaaaaccctgtgcatcatcattcttatccttgtcattggagttgcgattatcagtctcatcatatggggattgaaccactgaagttataaaggagcacactgtcgcactacattgtctaaattatgtaggaagattcctgtaatcatgtttttttaattattattttaaagctattgtataaaggatggttcccatactttgttatttttattgggggggttggggtggttcctttggattaaatctgatattttctaatactgaaagattttctaaatgtcactgctgacataactcccttggtcttcaatttaatagttgttaagtttttgcccacattgcatatgcctttcatttataatttatttaccctgcttgacttagttttgggaattcgtaaatttaaaggtgtgtgtattctgtttgcatctccctgtcactgtgacacacctagatgtgtgttacttcaattaaaattctcaaatttaattttgatttgcttcagcagggaaaatattctcaataatgtaaaataattaaggtctatacatgggttgtatttttctggttcacaacagcacaaagtgtctttcatttttttgttggttttcttttaagatcttttttaccctgaagtcagtgaatacttttctagtttatttgatactctttctgtgtatatattaagcttttgctgtagattgcctagtaaaattactaaggataggttgtttttacatatggtctatttaagtctgatgtttacgggggaaagtgtagttactaaaaatgtttaacataatttggaagaagagtatgaacaaccaataccaatacctattgcgtttggattcttaagaccccagtttgttattccactaaactagttatcttaaccatatcatctggttttgtgggccattatttaccttcccttatgtcttatagaataatggttaatatttttaggtcaaaattacttttggaaagtaactttcccacaattaactgtttttgagcacctgacaaaatttagtgtttaccttgcgtgccattttgtgtcatccttcattaaaaaagcaattggaggtttgccagttatctcacttccctttttaaatcaatgttgttttaatgcactaatctgaattctgtaaagaggattatcttagtttatactttgtattttataatgttcttgtatagcagttcggtactgaaggcggtgtttaacttggcaagctctgagacttcaaatgggaacaaatagtaagtagctaagtaaaccacatctttgcaaccaaaataaagatgagttaaaaggtatctggttaggcctatttcatgaggactatgctctggtgggaccacaggtcacctgatacttagtgctgtgctgcctgaaacctcagcatggagacatcaccacatgcactgtggccattcagcatctttctggagcaccagttcactccaggtttttattttagggtgtcatcgattttacctactttgtcagactggtagaagttgctttgcatatcagaaaaactccatttttttccacaaaagggattacagaaaactcttttgtgagtgagtgattggaacttagagactcctgttgccagaatcagactgccctagaacagaatggacaatgcagggaggagaattcacacaaacagcacctgttctgaggcctgtgccagcccaccaggcctgctcaaatgtggtctttacttcaagtgcacagaggcacatgaggtttctggtgataaaccagcgtcttaccgctgttttaaagtcccatccccatggctttcacaatcagttccgttttttttgctgtacttgataaaatgtttattctcatacaggtcaagtacatttacttctattcacagtgagtacccaataacaacaaaagcgcttacaaatttggggggcgtgattttagtacctttatttgaagtgtaatcattttaaattattattattttaactggggcagttatcagtggtttaaacaggaactttagtggcttcaattcgtttaagaaacatattaagtttgagggaaaaatttcccatgaaatatttggaacgtaagagtagtattgattagagaaaattaaataagaaacatagtatggtagccaaattttttaaaaaatcttgaacttttctgtaggtcagttttagaactgctgtgaaaagtgaaggttgccctgtggagattaaaattagagttgttttcataactgacagcatggtgaatccatttgagtcaaagtgaagaatttcctcatcaagtgactatacatttgtttttgtgtgctcaaaagaaatactcaaacacagactgatattaaccagccaggtaaattgaacgacaatgtggcattaggtatttggctgtttattggtcgttaaatactatggttttgcaatatgattgatggtaaaagagtgatgtcatattgatactagagtagcttgtttttttagtaggtgtgggaccatctcttttacaagtgcaactcagtctaggacagccatggatgcagtgtctggagttggaccctctgagcccgctggctgccccagtagcatctgcattggtgaccaaggacactgcactttgaagaggtcgccactgggttatttagtgtcttcactgcttttgttaaaaattgtaaaattttgtacacaaaaagttgtgtttttgaatatcaattgtttagacacacctacaatgataaataagtgcctttaaaggcccctctttccatgaaatacatctgtggtttagcaaggaaagtacaaaatagtttatgtagttggtataatttttatttgtgtcttcatgtagaaaaaatgaatgtcataataaaatataaaacttacgtaaaga

SEQ ID NO: 307541 - DNA, 3544 bp, Homo sapiens
  misc_feature (1)..(1): n is a, c, g, or t
nagaaacagataagtacactgctgcttctgttgcaactgttgcctcaattcaggtgaatcttgaggtgttccaagttgcaacagaagcagcagtatactaaccagcttgccaaagaaacagataagtacattaaagagtttggatctctgcccaccacccccagtgaacagcgtcaaaggaaaatacagaaggatcgcttagtggcagagttcacaacatcactgacaaacttccagaaggtccagaggcaggctgctgagcgagagaaagagtttgttgctcgagtaagagccagttccagagtgtctggcagttttcctgaggacagctcaaaagaaaggaatcttgtatcctgggaaagccaaactcaacctcaagtgcaggtgcaggatgaagaaattacagaggatgacctccgtcttattcatgagagagaatcttctatcaggcaacttgaagctgatattatggatattaatgaaatatttaaagatttgggaatgatgattcatgaacaaggagatgtaatagatagcatagaagccaatgtggaaaatgcagaggtgcacgttcagcaagcaaatcagcagctgtcaagggcagcagattatcagcgcaaatccagaaaaaccctgtgcatcatcattcttatccttgtcattggagttgcgattatcagtctcatcatatggggattgaaccactgaagttataaaggagcacactgtcgcactacattgtctaaattatgtaggaagattcctgtaatcatgtttttttaattattattttaaagctattgtataaaggatggttcccatactttgttatttttattgggggggttggggtggttcctttggattaaatctgatattttctaatactgaaagattttctaaatgtcactgctgacataactcccttggtcttcaatttaatagttgttaagtttttgcccacattgcatatgcctttcatttataatttatttaccctgcttgacttagttttgggaattcgtaaatttaaaggtgtgtgtattctgtttgcatctccctgtcactgtgacacacctagatgtgtgttacttcaattaaaattctcaaatttaattttgatttgcttcagcagggaaaatattctcaataatgtaaaataattaaggtctatacatgggttgtatttttctggttcacaacagcacaaagtgtctttcatttttttgttggttttcttttaagatcttttttaccctgaagtcagtgaatacttttctagtttatttgatactctttctgtgtatatattaagcttttgctgtagattgcctagtaaaattactaaggataggttgtttttacatatggtctatttaagtctgatgtttacgggggaaagtgtagttactaaaaatgtttaacataatttggaagaagagtatgaacaaccaataccaatacctattgcgtttggattcttaagaccccagtttgttattccactaaactagttatcttaaccatatcatctggttttgtgggccattatttaccttcccttatgtcttatagaataatggttaatatttttaggtcaaaattacttttggaaagtaactttcccacaattaactgtttttgagcacctgacaaaatttagtgtttaccttgcgtgccattttgtgtcatccttcattaaaaaagcaattggaggtttgccagttatctcacttccctttttaaatcaatgttgttttaatgcactaatctgaattctgtaaagaggattatcttagtttatactttgtattttataatgttcttgtatagcagttcggtactgaaggcggtgtttaacttggcaagctctgagacttcaaatgggaacaaatagtaagtagctaagtaaaccacatctttgcaaccaaaataaagatgagttaaaaggtatctggttaggcctatttcatgaggactatgctctggtgggaccacaggtcacctgatacttagtgctgtgctgcctgaaacctcagcatggagacatcaccacatgcactgtggccattcagcatctttctggagcaccagttcactccaggtttttattttagggtgtcatcgattttacctactttgtcagactggtagaagttgctttgcatatcagaaaaactccatttttttccacaaaagggattacagaaaactcttttgtgagtgagtgattggaacttagagactcctgttgccagaatcagactgccctagaacagaatggacaatgcagggaggagaattcacacaaacagcacctgttctgaggcctgtgccagcccaccaggcctgctcaaatgtggtctttacttcaagtgcacagaggcacatgaggtttctggtgataaaccagcgtcttaccgctgttttaaagtcccatccccatggctttcacaatcagttccgttttttttgctgtacttgataaaatgtttattctcatacaggtcaagtacatttacttctattcacagtgagtacccaataacaacaaaagcgcttacaaatttggggggcgtgattttagtacctttatttgaagtgtaatcattttaaattattattattttaactggggcagttatcagtggtttaaacaggaactttagtggcttcaattcgtttaagaaacatattaagtttgagggaaaaatttcccatgaaatatttggaacgtaagagtagtattgattagagaaaattaaataagaaacatagtatggtagccaaattttttaaaaaatcttgaacttttctgtaggtcagttttagaactgctgtgaaaagtgaaggttgccctgtggagattaaaattagagttgttttcataactgacagcatggtgaatccatttgagtcaaagtgaagaatttcctcatcaagtgactatacatttgtttttgtgtgctcaaaagaaatactcaaacacagactgatattaaccagccaggtaaattgaacgacaatgtggcattaggtatttggctgtttattggtcgttaaatactatggttttgcaatatgattgatggtaaaagagtgatgtcatattgatactagagtagcttgtttttttagtaggtgtgggaccatctcttttacaagtgcaactcagtctaggacagccatggatgcagtgtctggagttggaccctctgagcccgctggctgccccagtagcatctgcattggtgaccaaggacactgcactttgaagaggtcgccactgggttatttagtgtcttcactgcttttgttaaaaattgtaaaattttgtacacaaaaagttgtgtttttgaatatcaattgtttagacacacctacaatgataaataagtgcctttaaaggcccctctttccatgaaatacatctgtggtttagcaaggaaagtacaaaatagtttatgtagttggtataatttttatttgtgtcttcatgtagaaaaaatgaatgtcataataaaatataaaacttacgtaaaga

SEQ ID NO: 307542 - DNA, 3461 bp, Homo sapiens
catcataggttatcttgacacatatgaatgttaattatgtgcagttaaagtagtaagaatgtctgcccatcaaccccagttgaacagtcgtcaaaggaaaatacagaaggatcgcttagtggcagagttcacaacatcactgacaaacttccagaaggtccagaggcaggctgctgagcgagagaaagagtttgttgctcgagtaagagccagttccagagtgtctggcagttttcctgaggacagctcaaaagaaaggaatcttgtatcctgggaaagccaaactcaacctcaagtgcaggtgcaggatgaagaaattacagaggatgacctccgtcttattcatgagagagaatcttctatcaggcaacttgaagctgatattatggatattaatgaaatatttaaagatttgggaatgatgattcatgaacaaggagatgtaatagatagcatagaagccaatgtggaaaatgcagaggtgcacgttcagcaagcaaatcagcagctgtcaagggcagcagattatcagcgcaaatccagaaaaaccctgtgcatcatcattcttatccttgtcattggagttgcgattatcagtctcatcatatggggattgaaccactgaagttataaaggagcacactgtcgcactacattgtctaaattatgtaggaagattcctgtaatcatgtttttttaattattattttaaagctattgtataaaggatggttcccatactttgttatttttattgggggggttggggtggttcctttggattaaatctgatattttctaatactgaaagattttctaaatgtcactgctgacataactcccttggtcttcaatttaatagttgttaagtttttgcccacattgcatatgcctttcatttataatttatttaccctgcttgacttagttttgggaattcgtaaatttaaaggtgtgtgtattctgtttgcatctccctgtcactgtgacacacctagatgtgtgttacttcaattaaaattctcaaatttaattttgatttgcttcagcagggaaaatattctcaataatgtaaaataattaaggtctatacatgggttgtatttttctggttcacaacagcacaaagtgtctttcatttttttgttggttttcttttaagatcttttttaccctgaagtcagtgaatacttttctagtttatttgatactctttctgtgtatatattaagcttttgctgtagattgcctagtaaaattactaaggataggttgtttttacatatggtctatttaagtctgatgtttacgggggaaagtgtagttactaaaaatgtttaacataatttggaagaagagtatgaacaaccaataccaatacctattgcgtttggattcttaagaccccagtttgttattccactaaactagttatcttaaccatatcatctggttttgtgggccattatttaccttcccttatgtcttatagaataatggttaatatttttaggtcaaaattacttttggaaagtaactttcccacaattaactgtttttgagcacctgacaaaatttagtgtttaccttgcgtgccattttgtgtcatccttcattaaaaaagcaattggaggtttgccagttatctcacttccctttttaaatcaatgttgttttaatgcactaatctgaattctgtaaagaggattatcttagtttatactttgtattttataatgttcttgtatagcagttcggtactgaaggcggtgtttaacttggcaagctctgagacttcaaatgggaacaaatagtaagtagctaagtaaaccacatctttgcaaccaaaataaagatgagttaaaaggtatctggttaggcctatttcatgaggactatgctctggtgggaccacaggtcacctgatacttagtgctgtgctgcctgaaacctcagcatggagacatcaccacatgcactgtggccattcagcatctttctggagcaccagttcactccaggtttttattttagggtgtcatcgattttacctactttgtcagactggtagaagttgctttgcatatcagaaaaactccatttttttccacaaaagggattacagaaaactcttttgtgagtgagtgattggaacttagagactcctgttgccagaatcagactgccctagaacagaatggacaatgcagggaggagaattcacacaaacagcacctgttctgaggcctgtgccagcccaccaggcctgctcaaatgtggtctttacttcaagtgcacagaggcacatgaggtttctggtgataaaccagcgtcttaccgctgttttaaagtcccatccccatggctttcacaatcagttccgttttttttgctgtacttgataaaatgtttattctcatacaggtcaagtacatttacttctattcacagtgagtacccaataacaacaaaagcgcttacaaatttggggggcgtgattttagtacctttatttgaagtgtaatcattttaaattattattattttaactggggcagttatcagtggtttaaacaggaactttagtggcttcaattcgtttaagaaacatattaagtttgagggaaaaatttcccatgaaatatttggaacgtaagagtagtattgattagagaaaattaaataagaaacatagtatggtagccaaattttttaaaaaatcttgaacttttctgtaggtcagttttagaactgctgtgaaaagtgaaggttgccctgtggagattaaaattagagttgttttcataactgacagcatggtgaatccatttgagtcaaagtgaagaatttcctcatcaagtgactatacatttgtttttgtgtgctcaaaagaaatactcaaacacagactgatattaaccagccaggtaaattgaacgacaatgtggcattaggtatttggctgtttattggtcgttaaatactatggttttgcaatatgattgatggtaaaagagtgatgtcatattgatactagagtagcttgtttttttagtaggtgtgggaccatctcttttacaagtgcaactcagtctaggacagccatggatgcagtgtctggagttggaccctctgagcccgctggctgccccagtagcatctgcattggtgaccaaggacactgcactttgaagaggtcgccactgggttatttagtgtcttcactgcttttgttaaaaattgtaaaattttgtacacaaaaagttgtgtttttgaatatcaattgtttagacacacctacaatgataaataagtgcctttaaaggcccctctttccatgaaatacatctgtggtttagcaaggaaagtacaaaatagtttatgtagttggtataatttttatttgtgtcttcatgtagaaaaaatgaatgtcataataaaatataaaacttacgtaaaga

SEQ ID NO: 307543 - DNA, 3502 bp, Homo sapiens
  misc_feature (45)..(45): n is a, c, g, or t
  misc_feature (69)..(69): n is a, c, g, or t
gcgcgcgtcgacccggccgcctcgacacggtgcgagaagaccacngaaggccggccgacaacccggttngcccaaggaaacggttagttaccaaaggtttggatctctgcccaccacccccgtgaacagcgtcaaaggaaaatacagaaggatcgcttagtggcagagttcacaacatcactgacaaacttccagaaggtccagaggcaggctgctgagcgagagaaagagtttgttgctcgagtaagagccagttccagagtgtctggcagttttcctgaggacagctcaaaagaaaggaatcttgtatcctgggaaagccaaactcaacctcaagtgcaggtgcaggatgaagaaattacagaggatgacctccgtcttattcatgagagagaatcttctatcaggcaacttgaagctgatattatggatattaatgaaatatttaaagatttgggaatgatgattcatgaacaaggagatgtaatagatagcatagaagccaatgtggaaaatgcagaggtgcacgttcagcaagcaaatcagcagctgtcaagggcagcagattatcagcgcaaatccagaaaaaccctgtgcatcatcattcttatccttgtcattggagttgcgattatcagtctcatcatatggggattgaaccactgaagttataaaggagcacactgtcgcactacattgtctaaattatgtaggaagattcctgtaatcatgtttttttaattattattttaaagctattgtataaaggatggttcccatactttgttatttttattgggggggttggggtggttcctttggattaaatctgatattttctaatactgaaagattttctaaatgtcactgctgacataactcccttggtcttcaatttaatagttgttaagtttttgcccacattgcatatgcctttcatttataatttatttaccctgcttgacttagttttgggaattcgtaaatttaaaggtgtgtgtattctgtttgcatctccctgtcactgtgacacacctagatgtgtgttacttcaattaaaattctcaaatttaattttgatttgcttcagcagggaaaatattctcaataatgtaaaataattaaggtctatacatgggttgtatttttctggttcacaacagcacaaagtgtctttcatttttttgttggttttcttttaagatcttttttaccctgaagtcagtgaatacttttctagtttatttgatactctttctgtgtatatattaagcttttgctgtagattgcctagtaaaattactaaggataggttgtttttacatatggtctatttaagtctgatgtttacgggggaaagtgtagttactaaaaatgtttaacataatttggaagaagagtatgaacaaccaataccaatacctattgcgtttggattcttaagaccccagtttgttattccactaaactagttatcttaaccatatcatctggttttgtgggccattatttaccttcccttatgtcttatagaataatggttaatatttttaggtcaaaattacttttggaaagtaactttcccacaattaactgtttttgagcacctgacaaaatttagtgtttaccttgcgtgccattttgtgtcatccttcattaaaaaagcaattggaggtttgccagttatctcacttccctttttaaatcaatgttgttttaatgcactaatctgaattctgtaaagaggattatcttagtttatactttgtattttataatgttcttgtatagcagttcggtactgaaggcggtgtttaacttggcaagctctgagacttcaaatgggaacaaatagtaagtagctaagtaaaccacatctttgcaaccaaaataaagatgagttaaaaggtatctggttaggcctatttcatgaggactatgctctggtgggaccacaggtcacctgatacttagtgctgtgctgcctgaaacctcagcatggagacatcaccacatgcactgtggccattcagcatctttctggagcaccagttcactccaggtttttattttagggtgtcatcgattttacctactttgtcagactggtagaagttgctttgcatatcagaaaaactccatttttttccacaaaagggattacagaaaactcttttgtgagtgagtgattggaacttagagactcctgttgccagaatcagactgccctagaacagaatggacaatgcagggaggagaattcacacaaacagcacctgttctgaggcctgtgccagcccaccaggcctgctcaaatgtggtctttacttcaagtgcacagaggcacatgaggtttctggtgataaaccagcgtcttaccgctgttttaaagtcccatccccatggctttcacaatcagttccgttttttttgctgtacttgataaaatgtttattctcatacaggtcaagtacatttacttctattcacagtgagtacccaataacaacaaaagcgcttacaaatttggggggcgtgattttagtacctttatttgaagtgtaatcattttaaattattattattttaactggggcagttatcagtggtttaaacaggaactttagtggcttcaattcgtttaagaaacatattaagtttgagggaaaaatttcccatgaaatatttggaacgtaagagtagtattgattagagaaaattaaataagaaacatagtatggtagccaaattttttaaaaaatcttgaacttttctgtaggtcagttttagaactgctgtgaaaagtgaaggttgccctgtggagattaaaattagagttgttttcataactgacagcatggtgaatccatttgagtcaaagtgaagaatttcctcatcaagtgactatacatttgtttttgtgtgctcaaaagaaatactcaaacacagactgatattaaccagccaggtaaattgaacgacaatgtggcattaggtatttggctgtttattggtcgttaaatactatggttttgcaatatgattgatggtaaaagagtgatgtcatattgatactagagtagcttgtttttttagtaggtgtgggaccatctcttttacaagtgcaactcagtctaggacagccatggatgcagtgtctggagttggaccctctgagcccgctggctgccccagtagcatctgcattggtgaccaaggacactgcactttgaagaggtcgccactgggttatttagtgtcttcactgcttttgttaaaaattgtaaaattttgtacacaaaaagttgtgtttttgaatatcaattgtttagacacacctacaatgataaataagtgcctttaaaggcccctctttccatgaaatacatctgtggtttagcaaggaaagtacaaaatagtttatgtagttggtataatttttatttgtgtcttcatgtagaaaaaatgaatgtcataataaaatataaaacttacgtaaaga

SEQ ID NO: 307544 - DNA, 3759 bp, Homo sapiens
cacgagggccgctgtcactcagccccgcgggccaatagaaaaggggtgaaccccgccttcttcctgagttgtgctgcgggcatgcgcactgggcgtccccacgccaccgcccatcagctgagaattgcagctgagggctccggggtaggtgggtgacggcggtcggaggtgtaggagggagccgtggaggtccaggtgactgcttagaaaactgcacagcatctgatgaaattagcgaataagaacatcaaccatgtcttacactccaggagttggtggtgaccccgcccagttggcccagaggatctcttctaacatccagaagatcacacagtgttctgtggaaatacaaagaactctgaatcaacttggaacacctcaagattcacctgaattgaggcaacagttgcaacagaagcagcagtatactaaccagcttgccaaagaaacagataagtacattaaagagtttggatctctgcccaccacccccagtgaacagcgtcaaaggaaaatacagaaggatcgcttagtggcagagttcacaacatcactgacaaacttccagaaggtccagaggcaggctgctgagcgagagaaagagtttgttgctcgagtaagagccagttccagagtgtctggcagttttcctgaggacagctcaaaagaaaggaatcttgtatcctgggaaagccaaactcaacctcaagtgcaggtgcaggatgaagaaattacagaggatgacctccgtcttattcatgagagagaatcttctatcaggcaacttgaagctgatattatggatattaatgaaatatttaaagatttgggaatgatgattcatgaacaaggagatgtaatagatagcatagaagccaatgtggaaaatgcagaggtgcacgttcagcaagcaaatcagcagctgtcaagggcagcagattatcagcgcaaatccagaaaaaccctgtgcatcatcattcttatccttgtcattggagttgcgattatcagtctcatcatatggggattgaaccactgaagttataaaggagcacactgtcgcactacattgtctaaattatgtaggaagattcctgtaatcatgtttttttaattattattttaaagctattgtataaaggatggttcccatactttgttatttttattgggggggttggggtggttcctttggattaaatctgatattttctaatactgaaagattttctaaatgtcactgctgacataactcccttggtcttcaatttaatagttgttaagtttttgcccacattgcatatgcctttcatttataatttatttaccctgcttgacttagttttgggaattcgtaaatttaaaggtgtgtgtattctgtttgcatctccctgtcactgtgacacacctagatgtgtgttacttcaattaaaattctcaaatttaattttgatttgcttcagcagggaaaatattctcaataatgtaaaataattaaggtctatacatgggttgtatttttctggttcacaacagcacaaagtgtctttcatttttttgttggttttcttttaagatcttttttaccctgaagtcagtgaatacttttctagtttatttgatactctttctgtgtatatattaagcttttgctgtagattgcctagtaaaattactaaggataggttgtttttacatatggtctatttaagtctgatgtttacgggggaaagtgtagttactaaaaatgtttaacataatttggaagaagagtatgaacaaccaataccaatacctattgcgtttggattcttaagaccccagtttgttattccactaaactagttatcttaaccatatcatctggttttgtgggccattatttaccttcccttatgtcttatagaataatggttaatatttttaggtcaaaattacttttggaaagtaactttcccacaattaactgtttttgagcacctgacaaaatttagtgtttaccttgcgtgccattttgtgtcatccttcattaaaaaagcaattggaggtttgccagttatctcacttccctttttaaatcaatgttgttttaatgcactaatctgaattctgtaaagaggattatcttagtttatactttgtattttataatgttcttgtatagcagttcggtactgaaggcggtgtttaacttggcaagctctgagacttcaaatgggaacaaatagtaagtagctaagtaaaccacatctttgcaaccaaaataaagatgagttaaaaggtatctggttaggcctatttcatgaggactatgctctggtgggaccacaggtcacctgatacttagtgctgtgctgcctgaaacctcagcatggagacatcaccacatgcactgtggccattcagcatctttctggagcaccagttcactccaggtttttattttagggtgtcatcgattttacctactttgtcagactggtagaagttgctttgcatatcagaaaaactccatttttttccacaaaagggattacagaaaactcttttgtgagtgagtgattggaacttagagactcctgttgccagaatcagactgccctagaacagaatggacaatgcagggaggagaattcacacaaacagcacctgttctgaggcctgtgccagcccaccaggcctgctcaaatgtggtctttacttcaagtgcacagaggcacatgaggtttctggtgataaaccagcgtcttaccgctgttttaaagtcccatccccatggctttcacaatcagttccgttttttttgctgtacttgataaaatgtttattctcatacaggtcaagtacatttacttctattcacagtgagtacccaataacaacaaaagcgcttacaaatttggggggcgtgattttagtacctttatttgaagtgtaatcattttaaattattattattttaactggggcagttatcagtggtttaaacaggaactttagtggcttcaattcgtttaagaaacatattaagtttgagggaaaaatttcccatgaaatatttggaacgtaagagtagtattgattagagaaaattaaataagaaacatagtatggtagccaaattttttaaaaaatcttgaacttttctgtaggtcagttttagaactgctgtgaaaagtgaaggttgccctgtggagattaaaattagagttgttttcataactgacagcatggtgaatccatttgagtcaaagtgaagaatttcctcatcaagtgactatacatttgtttttgtgtgctcaaaagaaatactcaaacacagactgatattaaccagccaggtaaattgaacgacaatgtggcattaggtatttggctgtttattggtcgttaaatactatggttttgcaatatgattgatggtaaaagagtgatgtcatattgatactagatagcatctgcattggtgaccaaggacactgcactttgaagaggtcgccactgggttatttagtgtcttcactgcttttgttaaaaattgtaaaattttgtacacaaaaagttgtgtttttgaatatcaattgtttagacacacctacaatgataaataagtgcctttaaaggcccctctttccatgaaatacatctgtggtttagcaaggaaagtacaaaatagtttatgtagttggtataatttttatttgtgtcttcatgtagaaaaaatgaatgtcataataaaatataaaacttacgtaaaga

SEQ ID NO: 307545 - DNA, 3325 bp, Homo sapiens
tttattataagggaaaatatgagtgtttattttttctcatttttgctttttttgccccttctcattccatcctgttactaaattattcagggcagttttcctgaggacagctcaaaagaaaggaatcttgtatcctgggaaagccaaactcaacctcaagtgcaggtgcaggatgaagaaattacagaggatgacctccgtcttattcatgagagagaatcttctatcaggcaacttgaagctgatattatggatattaatgaaatatttaaagatttgggaatgatgattcatgaacaaggagatgtaatagatagcatagaagccaatgtggaaaatgcagaggtgcacgttcagcaagcaaatcagcagctgtcaagggcagcagattatcagcgcaaatccagaaaaaccctgtgcatcatcattcttatccttgtcattggagttgcgattatcagtctcatcatatggggattgaaccactgaagttataaaggagcacactgtcgcactacattgtctaaattatgtaggaagattcctgtaatcatgtttttttaattattattttaaagctattgtataaaggatggttcccatactttgttatttttattgggggggttggggtggttcctttggattaaatctgatattttctaatactgaaagattttctaaatgtcactgctgacataactcccttggtcttcaatttaatagttgttaagtttttgcccacattgcatatgcctttcatttataatttatttaccctgcttgacttagttttgggaattcgtaaatttaaaggtgtgtgtattctgtttgcatctccctgtcactgtgacacacctagatgtgtgttacttcaattaaaattctcaaatttaattttgatttgcttcagcagggaaaatattctcaataatgtaaaataattaaggtctatacatgggttgtatttttctggttcacaacagcacaaagtgtctttcatttttttgttggttttcttttaagatcttttttaccctgaagtcagtgaatacttttctagtttatttgatactctttctgtgtatatattaagcttttgctgtagattgcctagtaaaattactaaggataggttgtttttacatatggtctatttaagtctgatgtttacgggggaaagtgtagttactaaaaatgtttaacataatttggaagaagagtatgaacaaccaataccaatacctattgcgtttggattcttaagaccccagtttgttattccactaaactagttatcttaaccatatcatctggttttgtgggccattatttaccttcccttatgtcttatagaataatggttaatatttttaggtcaaaattacttttggaaagtaactttcccacaattaactgtttttgagcacctgacaaaatttagtgtttaccttgcgtgccattttgtgtcatccttcattaaaaaagcaattggaggtttgccagttatctcacttccctttttaaatcaatgttgttttaatgcactaatctgaattctgtaaagaggattatcttagtttatactttgtattttataatgttcttgtatagcagttcggtactgaaggcggtgtttaacttggcaagctctgagacttcaaatgggaacaaatagtaagtagctaagtaaaccacatctttgcaaccaaaataaagatgagttaaaaggtatctggttaggcctatttcatgaggactatgctctggtgggaccacaggtcacctgatacttagtgctgtgctgcctgaaacctcagcatggagacatcaccacatgcactgtggccattcagcatctttctggagcaccagttcactccaggtttttattttagggtgtcatcgattttacctactttgtcagactggtagaagttgctttgcatatcagaaaaactccatttttttccacaaaagggattacagaaaactcttttgtgagtgagtgattggaacttagagactcctgttgccagaatcagactgccctagaacagaatggacaatgcagggaggagaattcacacaaacagcacctgttctgaggcctgtgccagcccaccaggcctgctcaaatgtggtctttacttcaagtgcacagaggcacatgaggtttctggtgataaaccagcgtcttaccgctgttttaaagtcccatccccatggctttcacaatcagttccgttttttttgctgtacttgataaaatgtttattctcatacaggtcaagtacatttacttctattcacagtgagtacccaataacaacaaaagcgcttacaaatttggggggcgtgattttagtacctttatttgaagtgtaatcattttaaattattattattttaactggggcagttatcagtggtttaaacaggaactttagtggcttcaattcgtttaagaaacatattaagtttgagggaaaaatttcccatgaaatatttggaacgtaagagtagtattgattagagaaaattaaataagaaacatagtatggtagccaaattttttaaaaaatcttgaacttttctgtaggtcagttttagaactgctgtgaaaagtgaaggttgccctgtggagattaaaattagagttgttttcataactgacagcatggtgaatccatttgagtcaaagtgaagaatttcctcatcaagtgactatacatttgtttttgtgtgctcaaaagaaatactcaaacacagactgatattaaccagccaggtaaattgaacgacaatgtggcattaggtatttggctgtttattggtcgttaaatactatggttttgcaatatgattgatggtaaaagagtgatgtcatattgatactagagtagcttgtttttttagtaggtgtgggaccatctcttttacaagtgcaactcagtctaggacagccatggatgcagtgtctggagttggaccctctgagcccgctggctgccccagtagcatctgcattggtgaccaaggacactgcactttgaagaggtcgccactgggttatttagtgtcttcactgcttttgttaaaaattgtaaaattttgtacacaaaaagttgtgtttttgaatatcaattgtttagacacacctacaatgataaataagtgcctttaaaggcccctctttccatgaaatacatctgtggtttagcaaggaaagtacaaaatagtttatgtagttggtataatttttatttgtgtcttcatgtagaaaaaatgaatgtcataataaaatataaaacttacgtaaaga

SEQ ID NO: 307546 - DNA, 3385 bp, Homo sapiens
tgcattggtcttgacatagaccaagctgtggagtttgacactgagacatctcttgtgctgacactgatttgataatgtcagggtgacagtacttttcaggggttgccaggtagagctggagttgctctgtaatgaagatgattaaggttctgttatacaaatgctcttatattgtttggatcacctgaaaaatagtataggtgtatactataattcttaaagccagcttaaaaaaattcaactttatgatatactactattaacctttgaataatgaccatatttaatcttaccttgaatgaaatttagtgatttgttactggagcatcaatccatgtttaacacatttgtgtgtgtgtgttttattttacagatagcatagaagccaatgtggaaaatgcagaggtgcacgttcagcaagcaaatcagcagctgtcaagggcagcagattatcagcgcaaatccagaaaaaccctgtgcatcatcattcttatccttgtcattggagttgcgattatcagtctcatcatatggggattgaaccactgaagttataaaggagcacactgtcgcactacattgtctaaattatgtaggaagattcctgtaatcatgtttttttaattattattttaaagctattgtataaaggatggttcccatactttgttatttttattgggggggttggggtggttcctttggattaaatctgatattttctaatactgaaagattttctaaatgtcactgctgacataactcccttggtcttcaatttaatagttgttaagtttttgcccacattgcatatgcctttcatttataatttatttaccctgcttgacttagttttgggaattcgtaaatttaaaggtgtgtgtattctgtttgcatctccctgtcactgtgacacacctagatgtgtgttacttcaattaaaattctcaaatttaattttgatttgcttcagcagggaaaatattctcaataatgtaaaataattaaggtctatacatgggttgtatttttctggttcacaacagcacaaagtgtctttcatttttttgttggttttcttttaagatcttttttaccctgaagtcagtgaatacttttctagtttatttgatactctttctgtgtatatattaagcttttgctgtagattgcctagtaaaattactaaggataggttgtttttacatatggtctatttaagtctgatgtttacgggggaaagtgtagttactaaaaatgtttaacataatttggaagaagagtatgaacaaccaataccaatacctattgcgtttggattcttaagaccccagtttgttattccactaaactagttatcttaaccatatcatctggttttgtgggccattatttaccttcccttatgtcttatagaataatggttaatatttttaggtcaaaattacttttggaaagtaactttcccacaattaactgtttttgagcacctgacaaaatttagtgtttaccttgcgtgccattttgtgtcatccttcattaaaaaagcaattggaggtttgccagttatctcacttccctttttaaatcaatgttgttttaatgcactaatctgaattctgtaaagaggattatcttagtttatactttgtattttataatgttcttgtatagcagttcggtactgaaggcggtgtttaacttggcaagctctgagacttcaaatgggaacaaatagtaagtagctaagtaaaccacatctttgcaaccaaaataaagatgagttaaaaggtatctggttaggcctatttcatgaggactatgctctggtgggaccacaggtcacctgatacttagtgctgtgctgcctgaaacctcagcatggagacatcaccacatgcactgtggccattcagcatctttctggagcaccagttcactccaggtttttattttagggtgtcatcgattttacctactttgtcagactggtagaagttgctttgcatatcagaaaaactccatttttttccacaaaagggattacagaaaactcttttgtgagtgagtgattggaacttagagactcctgttgccagaatcagactgccctagaacagaatggacaatgcagggaggagaattcacacaaacagcacctgttctgaggcctgtgccagcccaccaggcctgctcaaatgtggtctttacttcaagtgcacagaggcacatgaggtttctggtgataaaccagcgtcttaccgctgttttaaagtcccatccccatggctttcacaatcagttccgttttttttgctgtacttgataaaatgtttattctcatacaggtcaagtacatttacttctattcacagtgagtacccaataacaacaaaagcgcttacaaatttggggggcgtgattttagtacctttatttgaagtgtaatcattttaaattattattattttaactggggcagttatcagtggtttaaacaggaactttagtggcttcaattcgtttaagaaacatattaagtttgagggaaaaatttcccatgaaatatttggaacgtaagagtagtattgattagagaaaattaaataagaaacatagtatggtagccaaattttttaaaaaatcttgaacttttctgtaggtcagttttagaactgctgtgaaaagtgaaggttgccctgtggagattaaaattagagttgttttcataactgacagcatggtgaatccatttgagtcaaagtgaagaatttcctcatcaagtgactatacatttgtttttgtgtgctcaaaagaaatactcaaacacagactgatattaaccagccaggtaaattgaacgacaatgtggcattaggtatttggctgtttattggtcgttaaatactatggttttgcaatatgattgatggtaaaagagtgatgtcatattgatactagagtagcttgtttttttagtaggtgtgggaccatctcttttacaagtgcaactcagtctaggacagccatggatgcagtgtctggagttggaccctctgagcccgctggctgccccagtagcatctgcattggtgaccaaggacactgcactttgaagaggtcgccactgggttatttagtgtcttcactgcttttgttaaaaattgtaaaattttgtacacaaaaagttgtgtttttgaatatcaattgtttagacacacctacaatgataaataagtgcctttaaaggcccctctttccatgaaatacatctgtggtttagcaaggaaagtacaaaatagtttatgtagttggtataatttttatttgtgtcttcatgtagaaaaaatgaatgtcataataaaatataaaacttacgtaaaga

SEQ ID NO: 307547 - DNA, 2284 bp, Homo sapiens
cacgagggccgctgtcactcagccccgcgggccaatagaaaaggggtgaaccccgccttcttcctgagttgtgctgcgggcatgcgcactgggcgtccccacgccaccgcccatcagctgagaattgcagctgagggctccggggtaggtgggtgacggcggtcggaggtgtaggagggagccgtggaggtccaggtgactgcttagaaaactgcacagcatctgatgaaattagcgaataagaacatcaaccatgtcttacactccaggagttggtggtgaccccgcccagttggcccagaggatctcttctaacatccagaagatcacacagtgttctgtggaaatacaaagaactctgaatcaacttggaacacctcaagattcacctgaattgaggcaacagttgcaacagaagcagcagtatactaaccagcttgccaaagaaacagataagtacattaaagagtttggatctctgcccaccacccccagtgaacagcgtcaaaggaaaatacagaaggatcgcttagtggcagagttcacaacatcactgacaaacttccagaaggtccagaggcaggctgctgagcgagagaaagagtttgttgctcgagtaagagccagttccagagtgtctggcagttttcctgaggacagctcaaaagaaaggaatcttgtatcctgggaaagccaaactcaacctcaagtgcaggtgcaggatgaagaaattacagaggatgacctccgtcttattcatgagagagaatcttctatcaggcaacttgaagctgatattatggatattaatgaaatatttaaagatttgggaatgatgattcatgaacaaggagatgtaatagatagcatagaagccaatgtggaaaatgcagaggtgcacgttcagcaagcaaatcagcagctgtcaagggcagcagattatcagcgcaaatccagaaaaaccctgtgcatcatcattcttatccttgtcattggagttgcgattatcagtctcatcatatggggattgaaccactgaagttataaaggagcacactgtcgcactacattgtctaaattatgtaggaagattcctgtaatcatgtttttttaattattattttaaagctattgtataaaggatggttcccatactttgttatttttattgggggggttggggtggttcctttggattaaatctgatattttctaatactgaaagattttctaaatgtcactgctgacataactcccttggtcttcaatttaatagttgttaagtttttgcccacattgcatatgcctttcatttataatttatttaccctgcttgacttagttttgggaattcgtaaatttaaaggtgtgtgtattctgtttgcatctccctgtcactgtgacacacctagatgtgtgttacttcaattaaaattctcaaatttaattttgatttgcttcagcagggaaaatattctcaataatgtaaaataattaaggtctatacatgggttgtatttttctggttcacaacagcacaaagtgtctttcatttttttgttggttttcttttaagatcttttttaccctgaagtcagtgaatacttttctagtttatttgatactctttctgtgtatatattaagcttttgctgtagattgcctagtaaaattactaaggataggttgtttttacatatggtctatttaagtctgatgtttacgggggaaagtgtagttactaaaaatgtttaacataatttggaagaagagtatgaacaaccaataccaatacctattgcgtttggattcttaagaccccagtttgttattccactaaactagttatcttaaccatatcatctggttttgtgggccattatttaccttcccttatgtcttatagaataatggttaatatttttaggtcaaaattacttttggaaagtaactttcccacaattaactgtttttgagcacctgacaaaatttagtgtttaccttgcgtgccattttgtgtcatccttcattaaaaaagcaattggaggtttgccagttatctcacttccctttttaaatcaatgttgttttaatgcactaatctgaattctgtaaagaggattatcttagtttatactttgtattttataatgttcttgtatagcagttcggtactgaaggcggtgtttaacttggcaagctctgagacttcaaatgggaacaaatagtaagtagctaagtaaaccacatctttgcaaccaaaataaagatgagttaaaaggta

SEQ ID NO: 307548 - DNA, 2051 bp, Homo sapiens
cacgagggccgctgtcactcagccccgcgggccaatagaaaaggggtgaaccccgccttcttcctgagttgtgctgcgggcatgcgcactgggcgtccccacgccaccgcccatcagctgagaattgcagctgagggctccggggtaggtgggtgacggcggtcggaggtgtaggagggagccgtggaggtccaggtgactgcttagaaaactgcacagcatctgatgaaattagcgaataagaacatcaaccatgtcttacactccaggagttggtggtgaccccgcccagttggcccagaggatctcttctaacatccagaagatcacacagtgttctgtggaaatacaaagaactctgaatcaacttggaacacctcaagattcacctgaattgaggcaacagttgcaacagaagcagcagtatactaaccagcttgccaaagaaacagataagtacattaaagagtttggatctctgcccaccacccccagtgaacagcgtcaaaggaaaatacagaaggatcgcttagtggcagagttcacaacatcactgacaaacttccagaaggtccagaggcaggctgctgagcgagagaaagagtttgttgctcgagtaagagccagttccagagtgtctggcagttttcctgaggacagctcaaaagaaaggaatcttgtatcctgggaaagccaaactcaacctcaagtgcaggtgcaggatgaagaaattacagaggatgacctccgtcttattcatgagagagaatcttctatcaggcaacttgaagctgatattatggatattaatgaaatatttaaagatttgggaatgatgattcatgaacaaggagatgtaatagatagcatagaagccaatgtggaaaatgcagaggtgcacgttcagcaagcaaatcagcagctgtcaagggcagcagattatcagcgcaaatccagaaaaaccctgtgcatcatcattcttatccttgtcattggagttgcgattatcagtctcatcatatggggattgaaccactgaagttataaaggagcacactgtcgcactacattgtctaaattatgtaggaagattcctgtaatcatgtttttttaattattattttaaagctattgtataaaggatggttcccatactttgttatttttattgggggggttggggtggttcctttggattaaatctgatattttctaatactgaaagattttctaaatgtcactgctgacataactcccttggtcttcaatttaatagttgttaagtttttgcccacattgcatatgcctttcatttataatttatttaccctgcttgacttagttttgggaattcgtaaatttaaaggtgtgtgtattctgtttgcatctccctgtcactgtgacacacctagatgtgtgttacttcaattaaaattctcaaatttaattttgatttgcttcagcagggaaaatattctcaataatgtaaaataattaaggtctatacatgggttgtatttttctggttcacaacagcacaaagtgtctttcatttttttgttggttttcttttaagatcttttttaccctgaagtcagtgaatacttttctagtttatttgatactctttctgtgtatatattaagcttttgctgtagattgcctagtaaaattactaaggataggttgtttttacatatggtctatttaagtctgatgtttacgggggaaagtgtagttactaaaaatgtttaacataatttggaagaagagtatgaacaaccaataccaatacctattgcgtttggattcttaagaccccagtttgttattccactaaactagttatcttaaccatatcatctggttttgtgggccattatttaccttcccttatgtcttatagaataatggttaatatttttaggtcaaaattacttttggaaagtaactttcccacaattaactgtttttgagcacctgacaaaatttagtgtttaccttgcgtgccattttgtgtcatccttcattaaaaaagcaattggaggttt

SEQ ID NO: 307549 - DNA, 1221 bp, Homo sapiens
cacgagggccgctgtcactcagccccgcgggccaatagaaaaggggtgaaccccgccttcttcctgagttgtgctgcgggcatgcgcactgggcgtccccacgccaccgcccatcagctgagaattgcagctgagggctccggggtaggtgggtgacggcggtcggaggtgtaggagggagccgtggaggtccaggtgactgcttagaaaactgcacagcatctgatgaaattagcgaataagaacatcaaccatgtcttacactccaggagttggtggtgaccccgcccagttggcccagaggatctcttctaacatccagaagatcacacagtgttctgtggaaatacaaagaactctgaatcaacttggaacacctcaagattcacctgaattgaggcaacagttgcaacagaagcagcagtatactaaccagcttgccaaagaaacagataagtacattaaagagtttggatctctgcccaccacccccagtgaacagcgtcaaaggaaaatacagaaggatcgcttagtggcagagttcacaacatcactgacaaacttccagaaggtccagaggcaggctgctgagcgagagaaagagtttgttgctcgagtaagagccagttccagagtgtctggcagttttcctgaggacagctcaaaagaaaggaatcttgtatcctgggaaagccaaactcaacctcaagtgcaggtgcaggatgaagaaattacagaggatgacctccgtcttattcatgagagagaatcttctatcaggcaacttgaagctgatattatggatattaatgaaatatttaaagatttgggaatgatgattcatgaacaaggagatgtaatagatagcatagaagccaatgtggaaaatgcagaggtgcacgttcagcaagcaaatcagcagctgtcaagggcagcagattatcagcgcaaatccagaaaaaccctgtgcatcatcattcttatccttgtcattggagttgcgattatcagtctcatcatatggggattgaaccactgaagttataaaggagcacactgtcgcactacattgtctaaattatgtaggaagattcctgtaatcatgtttttttaattattattttaaagctattgtataaaggatggttcccatactttgttatttttattgggggggttggggtggttcctttggattaaatctgatattttctaatactg

SEQ ID NO: 307550 - DNA, 1332 bp, Homo sapiens
cacgagggccgctgtcactcagccccgcgggccaatagaaaaggggtgaaccccgccttcttcctgagttgtgctgcgggcatgcgcactgggcgtccccacgccaccgcccatcagctgagaattgcagctgagggctccggggtaggtgggtgacggcggtcggaggtgtaggagggagccgtggaggtccaggtgactgcttagaaaactgcacagcatctgatgaaattagcgaataagaacatcaaccatgtcttacactccaggagttggtggtgaccccgcccagttggcccagaggatctcttctaacatccagaagatcacacagtgttctgtggaaatacaaagaactctgaatcaacttggaacacctcaagattcacctgaattgaggcaacagttgcaacagaagcagcagtatactaaccagcttgccaaagaaacagataagtacattaaagagtttggatctctgcccaccacccccagtgaacagcgtcaaaggaaaatacagaaggatcgcttagtggcagagttcacaacatcactgacaaacttccagaaggtccagaggcaggctgctgagcgagagaaagagtttgttgctcgagtaagagccagttccagagtgtctggcagttttcctgaggacagctcaaaagaaaggaatcttgtatcctgggaaagccaaactcaacctcaagtgcaggtgcaggatgaagaaattacagaggatgacctccgtcttattcatgagagagaatcttctatcaggcaacttgaagctgatattatggatattaatgaaatatttaaagatttgggaatgatgattcatgaacaaggagatgtaatagatagcatagaagccaatgtggaaaatgcagaggtgcacgttcagcaagcaaatcagcagctgtcaagggcagcagattatcagaaaaaggattcctgcatgttgatgtgaggtacaaacgccattaaagaaatctacaactgaaccaggaatgaagaacggaacaaaattcttaaccattcggttttcaatgacagcattatgattttgtttgctctgtggttttgtttgttgagattttgaatgtagtttcccattaatattaaagaatgagaatgattttggaaactcattccaaaatcattgtattttggaaacaagaaatatgtgtgaggggctgggcgtggtggctcacgcctgtaatcccagcactgtgggaggccgaagtgggcagatcatgaggtgaggagaatgggaccatcctggccaacatggtgaaactccgtctctactaaaaatacaaaaaaaaa

SEQ ID NO: 307551 - DNA, 792 bp, Homo sapiens
cacgagggccgctgtcactcagccccgcgggccaatagaaaaggggtgaaccccgccttcttcctgagttgtgctgcgggcatgcgcactgggcgtccccacgccaccgcccatcagctgagaattgcagctgagggctccggggtaggtgggtgacggcggtcggaggtgtaggagggagccgtggaggtccaggtgactgcttagaaaactgcacagcatctgatgaaattagcgaataagaacatcaaccatgtcttacactccaggagttggtggtgaccccgcccagttggcccagaggatctcttctaacatccagaagatcacacagtgttctgtggaaatacaaagaactctgaatcaacttggaacacctcaagattcacctgaattgaggcaacagttgcaacagaagcagcagtatactaaccagcttgccaaagaaacagataagtacattaaagagtttggatctctgcccaccacccccagtgaacagcgtcaaaggaaaatacagaaggatcgcttagtggcagagttcacaacatcactgacaaacttccagaaggtccagaggcaggctgctgagcgagagaaagagtttgttgctcgagtaagagccagttccagagtgtctggcagttttcctgaggacagctcaaaagaaaggaatcttgtatcctgggaaagccaaactcaacctcaagtgcaggtgcaggatgaagaaattacagaggaatgaaaacccccccttttttcccccctgggttttttccccttttttttttt

SEQ ID NO: 307552 - DNA, 866 bp, Homo sapiens
cacgagggccgctgtcactcagccccgcgggccaatagaaaaggggtgaaccccgccttcttcctgagttgtgctgcgggcatgcgcactgggcgtccccacgccaccgcccatcagctgagaattgcagctgagggctccggggtaggtgggtgacggcggtcggaggtgtaggagggagccgtggaggtccaggtgactgcttagaaaactgcacagcatctgatgaaattagcgaataagaacatcaaccatgtcttacactccaggagttggtggtgaccccgcccagttggcccagaggatctcttctaacatccagaagatcacacagtgttctgtggaaatacaaagaactctgaatcaacttggaacacctcaagattcacctgaattgaggcaacagttgtaagtatctagttaaataaataaaagagaaagaaaaaactctattgctattattctgttgcttttacagtatgtagtatattatgtttactggaagaaaaaatggaaaaacaatggagtttttctgctaccttatccatacatttgtaccaagcttttgtgtagatttttccctgtctggagtaggcaggtgtttttatattaaagatctggaagactgaggtgggcagatcacaagttcaggagttcgagaccaacctggccaatatggtgaaaccccgtctctgctgaaaataaaaaaattagccaggcgtggtggcgagcttctgtagtcctagctactcaggagcctgaggcaggtgaatctcttgaacccgggtggcggaggttgcagtgagccgagatcacaccactgcacttcagcctgggcgactgagcaagactctgtcttaaaaaaa

SEQ ID NO: 307553 - DNA, 597 bp, Homo sapiens
cacgagggccgctgtcactcagccccgcgggccaatagaaaaggggtgaaccccgccttcttcctgagttgtgctgcgggcatgcgcactgggcgtccccacgccaccgcccatcagctgagaattgcagctgagggctccggggtaggtgggtgacggcggtcggaggtgtaggagggagccgtggaggtccaggtgactgcttagaaaactgcacagcatctgatgaaattagcgaataagaacatcaaccatgtcttacactccaggagttggtggtgaccccgcccagttggcccagaggatctcttctaacatccagaagatcacacagtgttgtgagttgagttttaaatggacttcactatttgtatccactcttaactgaacttggtggaggttcataaaaggacaactctgctgattgagagagggaggagcattcctctaacaacaggttttaaagggctcgaactctttagaatgaatgcaagagaattatatttgagataacacttactgcatttttctataggaagtcagggccaggcacataatacattatttcattaaataaaataaagattaaggatagag

SEQ ID NO: 307554 - DNA, 658 bp, Homo sapiens
  misc_feature (411)..(411): n is a, c, g, or t
  misc_feature (435)..(435): n is a, c, g, or t
  misc_feature (479)..(479): n is a, c, g, or t
  misc_feature (550)..(550): n is a, c, g, or t
  misc_feature (602)..(602): n is a, c, g, or t
gatcccttcagccttggagggacctagccctggtcacaccttcatctcagacatgcggcccagagaactgaatgagaataaatgtgcgtgaagccctcagtccacaggatgtggtactggaagcccccactcaagaaggctccagtgaatgctggcacgtccagcctgggtgacagagcaagactctgtctcaaaaaaagaagcgggggagtgggggattgaggccacgtgcagtggctcactactgtaattccagcactttgggaggccgaggcaggaagattgcttgaactcaggagttcaagaccagtctgggcaacatggtgagaccctcgtctctacaaaaaaaaaattatcgtggtgggccgggcgtggtggctcacacctgtaatcccagcactttgggaggcngaggcgggcagatcacaaggtcangagatcgagaccatcctggccaacatggtgaaaccccgtctctnctaaaaatacaaaaattagccgggcatggtgttgcgtgcctgtagtcccagctacttgggaggctgaggcnggagaatcgcttgaacctgggaggcgcaggttgcagggaggcggaggttgcngtgagccgagattgcaccactgcacttcagcctggtgacagagcgagactcgtctc

SEQ ID NO: 307555 - DNA, 2018 bp, Homo sapiens
  misc_feature (1771)..(1771): n is a, c, g, or t
  misc_feature (1795)..(1795): n is a, c, g, or t
  misc_feature (1839)..(1839): n is a, c, g, or t
  misc_feature (1910)..(1910): n is a, c, g, or t
  misc_feature (1962)..(1962): n is a, c, g, or t
cggccccggccccggctccggcgctgctcccaccgccgcggcaacggccccggcccacggaggcggctggacggacccccgacggttggacgtacggactctgcttcgagagtaggccatggacaccttcagcaccaagagcctggctctgcaggcgcagaagaagctcctgagtaagatggcgtccaaggcagtggtggccgtgctggtggatgacaccagcagtgaggtgctggatgagctgtaccgcgccaccagggagttcacgcgcagccgcaaggaggcccagaagatgctcaagaacctggtcaaggtggccctgaagctgggactgctgctgcgtggggaccagctgggcggtgaggagctggcgctgctgcggcgcttccgccaccgggcgcgctgcctggccatgacggccgtcagcttccaccaggtggacttcaccttcgaccggcgcgtgctggccgccgggctgctcgagtgccgcgacctgctgcaccaggccgtgggtccccacctgaccgccaagtcccacggccgcatcaaccacgtgttcggccacctagccgactgcgacttcctggctgcgctctacggccccgccgagccctaccgctcccacctgcgcaggatctgcgagggcctgggccggatgctggacgagggcagcctctgaaccccggcgccgcccaaccgcgcccctcgcgccttttggggctctcctgctgggcgcgggtggggtttgtgggtttttttccacctcttttctcccaatcggactccggccaaactcccctagacagatgggtgacctgtctcctttgagaggatgctgaggcatctgtagcagctgtttcaaacaccaatgtcacctctcctcctggcccccgcccaatggggagaggaatttggggccctactctggggaccacctttcacccgtttgtactttctgggccacgccgacccctgggtcgcttgatgtaaaagccaaaagctgctgcctcccacttggatcatgtcgcctgggattttcatccctcgcacaaggactacgggttcacacggtgaactgggggaagggaagtgttagggggcaagtcgcggcacccccccttccataaactcacgtcctaacccccaggacctcagaagatgatctgatttggaaataggatcattacagatggaattagttcagatgatctcatcttggagtagggtgggccccaattcaaggactggggtccttaaaaaaagggggcctggggcagggcgcggtggctcacgcctgtaatcccagcactttgagaggctgaggcgggcggatcacgaggtcaggagatcgagaccatcctggctaacacggtgaaaccccatctctactgaaaatacaaaaaattagctgggcatggtggcacatgcctgtagtcccagctactcgggaggctgaggcaggataatcacttgaaccaggaggaggaggttgcagtgagccgagattgtgccactgcactccagcctgggtgacagagcaagactctgtctcaaaaaaagaagcgggggagtgggggattgaggccacgtgcagtggctcactactgtaattccagcactttgggaggccgaggcaggaagattgcttgaactcaggagttcaagaccagtctgggcaacatggtgagaccctcgtctctacaaaaaaaaaattatcgtggtgggccgggcgtggtggctcacacctgtaatcccagcactttgggaggcngaggcgggcagatcacaaggtcangagatcgagaccatcctggccaacatggtgaaaccccgtctctnctaaaaatacaaaaattagccgggcatggtgttgcgtgcctgtagtcccagctacttgggaggctgaggcnggagaatcgcttgaacctgggaggcgcaggttgcagggaggcggaggttgcngtgagccgagattgcaccactgcacttcagcctggtgacagagcgagactcgtctc

SEQ ID NO: 307556 - DNA, 2046 bp, Homo sapiens
  misc_feature (1799)..(1799): n is a, c, g, or t
  misc_feature (1823)..(1823): n is a, c, g, or t
  misc_feature (1867)..(1867): n is a, c, g, or t
  misc_feature (1938)..(1938): n is a, c, g, or t
  misc_feature (1990)..(1990): n is a, c, g, or t
gcatcggtccaggcatcggtggcggggagccaggcctaggccagcccgggcccacccagactggcccctaatgagctcccaagtggcctgtggggacttggcctcagttttgccagctgtgaactgggaccgtcgctgctaaggccatggacaccttcagcaccaagagcctggctctgcaggcgcagaagaagctcctgagtaagatggcgtccaaggcagtggtggccgtgctggtggatgacaccagcagtgaggtgctggatgagctgtaccgcgccaccagggagttcacgcgcagccgcaaggaggcccagaagatgctcaagaacctggtcaaggtggccctgaagctgggactgctgctgcgtggggaccagctgggcggtgaggagctggcgctgctgcggcgcttccgccaccgggcgcgctgcctggccatgacggccgtcagcttccaccaggtggacttcaccttcgaccggcgcgtgctggccgccgggctgctcgagtgccgcgacctgctgcaccaggccgtgggtccccacctgaccgccaagtcccacggccgcatcaaccacgtgttcggccacctagccgactgcgacttcctggctgcgctctacggccccgccgagccctaccgctcccacctgcgcaggatctgcgagggcctgggccggatgctggacgagggcagcctctgaaccccggcgccgcccaaccgcgcccctcgcgccttttggggctctcctgctgggcgcgggtggggtttgtgggtttttttccacctcttttctcccaatcggactccggccaaactcccctagacagatgggtgacctgtctcctttgagaggatgctgaggcatctgtagcagctgtttcaaacaccaatgtcacctctcctcctggcccccgcccaatggggagaggaatttggggccctactctggggaccacctttcacccgtttgtactttctgggccacgccgacccctgggtcgcttgatgtaaaagccaaaagctgctgcctcccacttggatcatgtcgcctgggattttcatccctcgcacaaggactacgggttcacacggtgaactgggggaagggaagtgttagggggcaagtcgcggcacccccccttccataaactcacgtcctaacccccaggacctcagaagatgatctgatttggaaataggatcattacagatggaattagttcagatgatctcatcttggagtagggtgggccccaattcaaggactggggtccttaaaaaaagggggcctggggcagggcgcggtggctcacgcctgtaatcccagcactttgagaggctgaggcgggcggatcacgaggtcaggagatcgagaccatcctggctaacacggtgaaaccccatctctactgaaaatacaaaaaattagctgggcatggtggcacatgcctgtagtcccagctactcgggaggctgaggcaggataatcacttgaaccaggaggaggaggttgcagtgagccgagattgtgccactgcactccagcctgggtgacagagcaagactctgtctcaaaaaaagaagcgggggagtgggggattgaggccacgtgcagtggctcactactgtaattccagcactttgggaggccgaggcaggaagattgcttgaactcaggagttcaagaccagtctgggcaacatggtgagaccctcgtctctacaaaaaaaaaattatcgtggtgggccgggcgtggtggctcacacctgtaatcccagcactttgggaggcngaggcgggcagatcacaaggtcangagatcgagaccatcctggccaacatggtgaaaccccgtctctnctaaaaatacaaaaattagccgggcatggtgttgcgtgcctgtagtcccagctacttgggaggctgaggcnggagaatcgcttgaacctgggaggcgcaggttgcagggaggcggaggttgcngtgagccgagattgcaccactgcacttcagcctggtgacagagcgagactcgtctc

SEQ ID NO: 307557 - DNA, 960 bp, Homo sapiens
cggccccggccccggctccggcgctgctcccaccgccgcggcaacggccccggcccacggaggcggctggacggacccccgacggttggacgtacggactctgcttcgagagtaggccatggacaccttcagcaccaagagcctggctctgcaggcgcagaagaagctcctgagtaagatggcgtccaaggcagtggtggccgtgctggtggatgacaccagcagtgaggtgctggatgagctgtaccgcgccaccagggagttcacgcgcagccgcaaggaggcccagaagatgctcaagaacctggtcaaggtggccctgaagctgggactgctgctgcgtggggaccagctgggcggtgaggagctggcgctgctgcggcgcttccgccaccgggcgcgctgcctggccatgacggccgtcagcttccaccaggtggacttcaccttcgaccggcgcgtgctggccgccgggctgctcgagtgccgcgacctgctgcaccaggccgtgggtccccacctgaccgccaagtcccacggccgcatcaaccacgtgttcggccacctagccgactgcgacttcctggctgcgctctacggccccgccgagccctaccgctcccacctgcgcaggatctgcgagggcctgggccggatgctggacgagggcagcctctgaaccccggcgccgcccaaccgcgcccctcgcgccttttggggctctcctgctgggcgcgggtggggtttgtgggtttttttccacctcttttctcccaatcggactccggccaaactcccctagacagatgggtgacctgtctcctttgagaggatgctgaggcatctgtagcagctgtttcaaacaccaatgtcacctctcctcctggcccccgcccaatggggagaggaatttggggccctactctgggccttcacgttgtttggcacgcccttctttta

SEQ ID NO: 307558 - DNA, 743 bp, Homo sapiens
gcggtataggttagggggagacagattgagtctcaattgccccccttggcgtggggctctgctctgggaccagcacccccatcccccatgtggactctagtggactctgccccctttaactgtagggccgcaggtgctcaggccagattccagaaccctgagggcattccaggcggtgggcagctgggccagccgtgcggaggtgggcatgactgtagcttctagctaaaccaggcatcggtccaggcatcggtggcggggagccaggcctaggccagcccgggcccacccagactggcccctaatgagctcccaagtggcctgtggggacttggcctcagttttgccagctgtgaactgggaccgtcgctgctaaggtaattggcaggtgatctgaaggacacctgccgcctcctggccttttctgtgaagtcgaactaggcccatttcctgggatgggaaactaaggcctagaaagaggccaatgcttccaatgtttggccagggaagtggggacagaggcaggacagaatctgttttctctgcatcctcacatttcccagcaccttctctatggaggggggaagggctggtggaggagcagccccaggtgtaaaccaggccgccagagtttatttcctgagccagtcccagctcagctggaggcgatgaacgccttgggaggccccaggggggccagcccagtggtggcggacttggaccatctaggtttgagctctgcc

SEQ ID NO: 307559 - DNA, 942 bp, Homo sapiens
cggatatacagacaaaccatgggttaatagactccataaatttgtggtaagtcattctgggcgccagctagagtttaccttgtgtgctgtttatcaccgtaataagctaagcctctcgggaatgtaaacgagtgaaggtcttgatgaacttaagaacaaactctgaaggccttgaagcttgggttggttgtttatgtacagacagatgctgttaaggcacaaatctgccttaaccagccactacagcaggccaagcaggacctctgcttgcaagcattagcaatttgagttactgcctgtgcctgtctttgaaattaaaaacagtgggttttaaaagcacacacaaaaggtacacactccggtgaggctgtggcaccatcctctagcagtgggccccagcagtaacaaagggtacctccaggggtttgggtagcgctgccctctggcagtcatgcaccgctgtctgccatagccgctctagggtcttggcagaattctgagcttgaagtgcagctcccttactaccctttcccttcctttttcttccctaataggaggtacaatctgcttttgtttgtcgttaagtggtcactcccatttcctttatcttggccgacaacacagagaggagggggagctgggcagtagcttggggtgggggtgggcacctgtggttgtttttaatgggaaatacctctcagagatgttcatgcaggctccctagggccccatcccagtgccaggctggtttccatggagatagggcactgaggctcccgtgaggttggaatcgacttcaccatgggggtccttcagccagcatccagctccccacccccaggctggcagtagcactgctgagatgctgtatttccacccaattctgggtatatcagtgtgtcttgcagaatcttggatcattaaagataaacatatttttaa

SEQ ID NO: 307560 - DNA, 697 bp, Homo sapiens
  misc_feature (125)..(125): n is a, c, g, or t
  misc_feature (127)..(127): n is a, c, g, or t
  misc_feature (129)..(129): n is a, c, g, or t
  misc_feature (137)..(138): n is a, c, g, or t
  misc_feature (142)..(142): n is a, c, g, or t
  misc_feature (146)..(146): n is a, c, g, or t
  misc_feature (151)..(151): n is a, c, g, or t
  misc_feature (153)..(153): n is a, c, g, or t
  misc_feature (156)..(156): n is a, c, g, or t
  misc_feature (159)..(159): n is a, c, g, or t
  misc_feature (167)..(168): n is a, c, g, or t
  misc_feature (178)..(178): n is a, c, g, or t
  misc_feature (182)..(182): n is a, c, g, or t
  misc_feature (203)..(203): n is a, c, g, or t
taaacagacgactcaggagccacagaaggagaggccatgtagatgggaaggggcagcacactctctgcagagcagccttgcctcagctctgcacgacgcgaggaccgaccctttgcacccatggncntntacatggnnaggncagngaatnanccntgnactatggnnttcagcaaangctncaagaagaagttcttctacancaagaaacagaaaaaaagagttgcagagcttgccctgagcctcagctccacgtccgatgatgaacctcccttactaccctttcccttcctttttcttccctaataggaggtacaatctgcttttgtttgtcgttaagtggtcactcccatttcctttatcttggccgacaacacagagaggagggggagctgggcagtagcttggggtgggggtgggcacctgtggttgtttttaatgggaaatacctctcagagatgttcatgcaggctccctagggccccatcccagtgccaggctggtttccatggagatagggcactgaggctcccgtgaggttggaatcgacttcaccatgggggtccttcagccagcatccagctccccacccccaggctggcagtagcactgctgagatgctgtatttccacccaattctgggtatatcagtgtgtcttgcagaatcttggatcattaaagataaacatatttttaa

SEQ ID NO: 307561 - DNA, 2201 bp, Homo sapiens
  misc_feature (5)..(5): n is a, c, g, or t
  misc_feature (8)..(8): n is a, c, g, or t
tgccngcngtactggacccgagcgcgacggtgcggctggcggacccgggctggcttgtggggaaacgaaactgagggaggaggcggcggctctggcagcggcggcgacagtgtcggcctgaccccccctccgctccccggcagctcgctctctcccctcagcttaacgatgaagaggagaactgacccagaatgcactgcccccatcaagaaacagaaaaaaagagttgcagagcttgccctgagcctcagctccacgtccgatgatgaacctccctcctctgtcagtcatggagcaaaagcatctactacaagccttagtgggtctgatagtgagaccgaggggaaacaacacagctctgactcttttgacgatgcattcaaagcagactctcttgtggaaggaacttcttctcgctattccatgtataatagcgtctcccagaagcttatggccaagatgggcttcagggaaggtgaaggattgggtaaatacagccagggtcggaaggacatcgttgaggcttccagtcagaaaggtcgaagaggcttgggtctgacactccggggctttgaccaggagctgaacgtggactggcgagatgagccagagcccagtgcttgtgagcaggtgtcatggtttccagaatgtaccactgaaattcctgacactcaggaaatgagcgattggatggtggtgggaaagagaaagatgattattgaagatgaaacagagttttgtggggaagagctgcttcacagtgtgttgcagtgtaagaagccactggtgaaggaccgggaagctgagcttctgtactttgctgatgtctgcgcaggcccaggtggcttctcagagtatgtgctgtggaggaagaagtggcatgcaaagggctttggaatgactttgaagggccctaatgacttcaagctggaggacttctactctgcttccagtgaactcttcgaaccctactatggtgagggtgggattgatggagatggagatatcacccgcccagagaacatctctgcttttcggaattttgtcctggataacacagatcgcaagggtgtccattttctgatggctgatgggggtttctcggtggaggggcaggagaacctgcaggagatcctcagcaagcagctgcttctgtgtcagttcctcatggcgctgtccattgtccggacaggaggccacttcatctgtaaaacctttgacctgttcacaccgtttagtgtggggcttgtctacctgctgtactgctgctttgaacgagtttgtatgaaaacattctcctccgcataagcctgcgtcagattaaaacactgaactgacaattaacagcccaatatctacaatcaaccaaaaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaccctatggagctttaatttattaatgcaaacagtacctaacaaacccacaggtcctaaactaccaaacccgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagggtttgtt

SEQ ID NO: 307562 - DNA, 581 bp, Homo sapiens
atgcctcataatttttttattaaatgccagacattgtgtgtaaagaacagtgaagactaaagtagaaagggtggctgttagtatacataggtcgagtaagcttagtctatagttgaactgaatctgggctttgaatgagctcaccactactttcagattatttaagggtgggattagaagcttccttttagtaggacttgggatctaagaactgagtgacccagttttcctgttctaccctcatccttcagtaagccccacataactgcactgtggggtaggggtgtgggtttctttctcaactctccagctccttcaccaaatatagatggccactgctcccgtttaacctctctgtcctgatgtcagttacctgtcttttttggtaatcctgagatcaaataatttttttttcttctagccactgtagtctgcagatcaaagctctggcgaaaatccatgcctttgttcaagacacgtgagtgttgcccacttttcagaaaccacctatttcaagggaagatcttgcttttcctccccacaagctgtttgtttttttcatttcaacaaacattttaaaa

SEQ ID NO: 307563 - DNA, 4039 bp, Homo sapiens
  misc_feature (5)..(5): n is a, c, g, or t
  misc_feature (8)..(8): n is a, c, g, or t
tgccngcngtactggacccgagcgcgacggtgcggctggcggacccgggctggcttgtggggaaacgaaactgagggaggaggcggcggctctggcagcggcggcgacagtgtcggcctgaccccccctccgctccccggcagctcgctctctcccctcagcttaacgatgaagaggagaactgacccagaatgcactgcccccatcaagaaacagaaaaaaagagttgcagagcttgccctgagcctcagctccacgtccgatgatgaacctccctcctctgtcagtcatggagcaaaagcatctactacaagccttagtgggtctgatagtgagaccgaggggaaacaacacagctctgactcttttgacgatgcattcaaagcagactctcttgtggaaggaacttcttctcgctattccatgtataatagcgtctcccagaagcttatggccaagatgggcttcagggaaggtgaaggattgggtaaatacagccagggtcggaaggacatcgttgaggcttccagtcagaaaggtcgaagaggcttgggtctgacactccggggctttgaccaggagctgaacgtggactggcgagatgagccagagcccagtgcttgtgagcaggtgtcatggtttccagaatgtaccactgaaattcctgacactcaggaaatgagcgattggatggtggtgggaaagagaaagatgattattgaagatgaaacagagttttgtggggaagagctgcttcacagtgtgttgcagtgtaagagcgtgtttgatgtcttggatggggaagagatgcggcgagctcggactcgggccaatccctatgagatgatccgaggagtcttctttctaaacagggcagcaatgaagatggctaacatggattttgtatttgatcgcatgttcacaaatccgcgggactcttatgggaagccactggtgaaggaccgggaagctgagcttctgtactttgctgatgtctgcgcaggcccaggtggcttctcagagtatgtgctgtggaggaagaagtggcatgcaaagggctttggaatgactttgaagggccctaatgacttcaagctggaggacttctactctgcttccagtgaactcttcgaaccctactatggtgagggtgggattgatggagatggagatatcacccgcccagagaacatctctgcttttcggaattttgtcctggataacacagatcgcaagggtgtccattttctgatggctgatgggggtttctcggtggaggggcaggagaacctgcaggagatcctcagcaagcagctgcttctgtgtcagttcctcatggcgctgtccattgtccggacaggaggccacttcatctgtaaaacctttgacctgttcacaccgtttagtgtggggcttgtctacctgctgtactgctgctttgaacgagtttgtctcttcaagcctattaccagccgtcctgccaactcagagaggtatgtggtgtgcaagggcctgaaggtgggcatagatgatgttcgggattacctcttcgcagtgaatattaaactcaatcagctgcggaacacggattccgacgtcaacttggtggtccccctggaggtgatcaagggagaccatgaatttactgactacatgatacggtccaatgagagccactgtagtctgcagatcaaagctctggcgaaaatccatgcctttgttcaagacacgacactgagtgagcctcgacaggcagagatacggaaggagtgcctccgactctgggggatcccagaccaggctcgtgtggctccttcttcctccgaccctaaatcgaagttctttgagctaatccagggcactgagattgacatcttcagctacaagcccacactgctcacctctaaaaccctggagaagatccgccctgtgtttgactaccgctgcatggtatctggcagtgagcagaagttcctcatcggcctggggaaatcccagatctacacatgggatggccgccagtcagaccgctggatcaagctagacctgaagacagagctgccccgggacactctgctatctgtggaaattgtgcatgagctgaaaggggaggggaaggcccagaggaagatcagtgccatccacatcctcgatgtccttgtgctgaatggcaccgacgttcgggagcagcactttaaccagcgaattcagcttgccgagaaatttgtgaaagccgtttccaagcctagtcggcccgacatgaatcccatcagggtgaaggaggtgtacagactggaagagatggagaagatttttgtcaggttggagatgaagatcatcaagggctccagtggcaccccaaagctcagctacacagggcgtgatgaccggcactttgtacccatgggcctctacatcgtcaggacagtgaatgagccctggactatgggattcagcaaaagcttcaagaagaagttcttctacaacaagaaaaccaaggactctacttttgacctccctgcagactccattgccccatttcacatttgctactatggccggctcttctgggagtggggggatggcattcgtgtgcatgactcccagaagccccaggaccaggacaagctgtccaaggaggacgtcctctccttcatccagatgcacagggcctaagagcctcagaatgtgccacccctgcagaatgccctgtcattcctgagatggggccacctggggcccacagtggtggcttcttccccctcttgaaaagggactggggagcattgcacctggcatgaggagtgggtggcctcctctccatcccctgaagagctcaggcagggccctgcagagaacactcatgttccttctgggacacctgcctgggaactttcccctgccaggactcagcctgaaggaagctgctcctgaggcaggtatgaggtcagtgcctagggcacgtgggactgatggaggacatatcagagtggcagagctgtgggctctgctgttctctcctgcatcctgtagactcacttttctgagttccatgcactgccctgagggtagccatgcccttgctttgcccaactttttattgggccatccctgagtgggtggagacctgctgtcatgagctggccaggagaacctgctataaaaaaatcaaggttttgtttctttgaacttactctgttttgatgccaaattggagaccattttcttgtctccttcccccactcatcctggccttccctggagttcttcctagcccagagctctgacagtccagcagggtgggaaggagggagtttgggcaaactctcatccctgataccacattgagatcctgggagccctcttttcgtactgagtatggagttgtagagccatcctaggtgccatccccttttggtccaaacattgggcagcgctagatggcaggaagcagccttgaagacccgtctttcccccacagcagcaggggccccagcagtaacaaagggtacctccaggggtttgggtagcgctgccctctggcagtcatgcaccgctgtctgccatagccgctctagggtcttggcagaattctgagcttgaagtgcagctcccttactaccctttcccttcctttttcttccctaataggaggtacaatctgcttttgtttgtcgttaagtggtcactcccatttcctttatcttggccgacaacacagagaggagggggagctgggcagtagcttggggtgggggtgggcacctgtggttgtttttaatgggaaatacctctcagagatgttcatgcaggctccctagggccccatcccagtgccaggctggtttccatggagatagggcactgaggctcccgtgaggttggaatcgacttcaccatgggggtccttcagccagcatccagctccccacccccaggctggcagtagcactgctgagatgctgtatttccacccaattctgggtatatcagtgtgtcttgcagaatcttggatcattaaagataaacatatttttaa

SEQ ID NO: 307564 - DNA, 4036 bp, Homo sapiens
  misc_feature (125)..(125): n is a, c, g, or t
  misc_feature (127)..(127): n is a, c, g, or t
  misc_feature (129)..(129): n is a, c, g, or t
  misc_feature (137)..(138): n is a, c, g, or t
  misc_feature (142)..(142): n is a, c, g, or t
  misc_feature (146)..(146): n is a, c, g, or t
  misc_feature (151)..(151): n is a, c, g, or t
  misc_feature (153)..(153): n is a, c, g, or t
  misc_feature (156)..(156): n is a, c, g, or t
  misc_feature (159)..(159): n is a, c, g, or t
  misc_feature (167)..(168): n is a, c, g, or t
  misc_feature (178)..(178): n is a, c, g, or t
  misc_feature (182)..(182): n is a, c, g, or t
  misc_feature (203)..(203): n is a, c, g, or t
taaacagacgactcaggagccacagaaggagaggccatgtagatgggaaggggcagcacactctctgcagagcagccttgcctcagctctgcacgacgcgaggaccgaccctttgcacccatggncntntacatggnnaggncagngaatnanccntgnactatggnnttcagcaaangctncaagaagaagttcttctacancaagaaacagaaaaaaagagttgcagagcttgccctgagcctcagctccacgtccgatgatgaacctccctcctctgtcagtcatggagcaaaagcatctactacaagccttagtgggtctgatagtgagaccgaggggaaacaacacagctctgactcttttgacgatgcattcaaagcagactctcttgtggaaggaacttcttctcgctattccatgtataatagcgtctcccagaagcttatggccaagatgggcttcagggaaggtgaaggattgggtaaatacagccagggtcggaaggacatcgttgaggcttccagtcagaaaggtcgaagaggcttgggtctgacactccggggctttgaccaggagctgaacgtggactggcgagatgagccagagcccagtgcttgtgagcaggtgtcatggtttccagaatgtaccactgaaattcctgacactcaggaaatgagcgattggatggtggtgggaaagagaaagatgattattgaagatgaaacagagttttgtggggaagagctgcttcacagtgtgttgcagtgtaagagcgtgtttgatgtcttggatggggaagagatgcggcgagctcggactcgggccaatccctatgagatgatccgaggagtcttctttctaaacagggcagcaatgaagatggctaacatggattttgtatttgatcgcatgttcacaaatccgcgggactcttatgggaagccactggtgaaggaccgggaagctgagcttctgtactttgctgatgtctgcgcaggcccaggtggcttctcagagtatgtgctgtggaggaagaagtggcatgcaaagggctttggaatgactttgaagggccctaatgacttcaagctggaggacttctactctgcttccagtgaactcttcgaaccctactatggtgagggtgggattgatggagatggagatatcacccgcccagagaacatctctgcttttcggaattttgtcctggataacacagatcgcaagggtgtccattttctgatggctgatgggggtttctcggtggaggggcaggagaacctgcaggagatcctcagcaagcagctgcttctgtgtcagttcctcatggcgctgtccattgtccggacaggaggccacttcatctgtaaaacctttgacctgttcacaccgtttagtgtggggcttgtctacctgctgtactgctgctttgaacgagtttgtctcttcaagcctattaccagccgtcctgccaactcagagaggtatgtggtgtgcaagggcctgaaggtgggcatagatgatgttcgggattacctcttcgcagtgaatattaaactcaatcagctgcggaacacggattccgacgtcaacttggtggtccccctggaggtgatcaagggagaccatgaatttactgactacatgatacggtccaatgagagccactgtagtctgcagatcaaagctctggcgaaaatccatgcctttgttcaagacacgacactgagtgagcctcgacaggcagagatacggaaggagtgcctccgactctgggggatcccagaccaggctcgtgtggctccttcttcctccgaccctaaatcgaagttctttgagctaatccagggcactgagattgacatcttcagctacaagcccacactgctcacctctaaaaccctggagaagatccgccctgtgtttgactaccgctgcatggtatctggcagtgagcagaagttcctcatcggcctggggaaatcccagatctacacatgggatggccgccagtcagaccgctggatcaagctagacctgaagacagagctgccccgggacactctgctatctgtggaaattgtgcatgagctgaaaggggaggggaaggcccagaggaagatcagtgccatccacatcctcgatgtccttgtgctgaatggcaccgacgttcgggagcagcactttaaccagcgaattcagcttgccgagaaatttgtgaaagccgtttccaagcctagtcggcccgacatgaatcccatcagggtgaaggaggtgtacagactggaagagatggagaagatttttgtcaggttggagatgaagatcatcaagggctccagtggcaccccaaagctcagctacacagggcgtgatgaccggcactttgtacccatgggcctctacatcgtcaggacagtgaatgagccctggactatgggattcagcaaaagcttcaagaagaagttcttctacaacaagaaaaccaaggactctacttttgacctccctgcagactccattgccccatttcacatttgctactatggccggctcttctgggagtggggggatggcattcgtgtgcatgactcccagaagccccaggaccaggacaagctgtccaaggaggacgtcctctccttcatccagatgcacagggcctaagagcctcagaatgtgccacccctgcagaatgccctgtcattcctgagatggggccacctggggcccacagtggtggcttcttccccctcttgaaaagggactggggagcattgcacctggcatgaggagtgggtggcctcctctccatcccctgaagagctcaggcagggccctgcagagaacactcatgttccttctgggacacctgcctgggaactttcccctgccaggactcagcctgaaggaagctgctcctgaggcaggtatgaggtcagtgcctagggcacgtgggactgatggaggacatatcagagtggcagagctgtgggctctgctgttctctcctgcatcctgtagactcacttttctgagttccatgcactgccctgagggtagccatgcccttgctttgcccaactttttattgggccatccctgagtgggtggagacctgctgtcatgagctggccaggagaacctgctataaaaaaatcaaggttttgtttctttgaacttactctgttttgatgccaaattggagaccattttcttgtctccttcccccactcatcctggccttccctggagttcttcctagcccagagctctgacagtccagcagggtgggaaggagggagtttgggcaaactctcatccctgataccacattgagatcctgggagccctcttttcgtactgagtatggagttgtagagccatcctaggtgccatccccttttggtccaaacattgggcagcgctagatggcaggaagcagccttgaagacccgtctttcccccacagcagcaggggccccagcagtaacaaagggtacctccaggggtttgggtagcgctgccctctggcagtcatgcaccgctgtctgccatagccgctctagggtcttggcagaattctgagcttgaagtgcagctcccttactaccctttcccttcctttttcttccctaataggaggtacaatctgcttttgtttgtcgttaagtggtcactcccatttcctttatcttggccgacaacacagagaggagggggagctgggcagtagcttggggtgggggtgggcacctgtggttgtttttaatgggaaatacctctcagagatgttcatgcaggctccctagggccccatcccagtgccaggctggtttccatggagatagggcactgaggctcccgtgaggttggaatcgacttcaccatgggggtccttcagccagcatccagctccccacccccaggctggcagtagcactgctgagatgctgtatttccacccaattctgggtatatcagtgtgtcttgcagaatcttggatcattaaagataaacatatttttaa

SEQ ID NO: 307565 - DNA, 4543 bp, Homo sapiens
  misc_feature (5)..(5): n is a, c, g, or t
  misc_feature (8)..(8): n is a, c, g, or t
tgccngcngtactggacccgagcgcgacggtgcggctggcggacccgggctggcttgtggggaaacgaaactgagggaggaggcggcggctctggcagcggcggcgacagtgtcggcctgaccccccctccgctccccggcagctcgctctctcccctcagcttaacgatgaagaggagaactgacccagaatgcactgcccccatcaagaaacagaaaaaaagagttgcagagcttgccctgagcctcagctccacgtccgatgatgaacctccctcctctgtcagtcatggagcaaaagcatctactacaagccttagtgggtctgatagtgagaccgaggggaaacaacacagctctgactcttttgacgatgcattcaaagcagactctcttgtggaaggaacttcttctcgctattccatgtataatagcgtctcccagaagcttatggccaagatgggcttcagggaaggtgaaggattgggtaaatacagccagggtcggaaggacatcgttgaggcttccagtcagaaaggtcgaagaggcttgggtctgacactccggggctttgaccaggagctgaacgtggactggcgagatgagccagagcccagtgcttgtgagcaggtgtcatggtttccagaatgtaccactgaaattcctgacactcaggaaatgagcgattggatggtggtgggaaagagaaagatgattattgaagatgaaacagagttttgtggggaagagctgcttcacagtgtgttgcagtgtaagagcgtgtttgatgtcttggatggggaagagatgcggcgagctcggactcgggccaatccctatgagatgatccgaggagtcttctttctaaacagggcagcaatgaagatggctaacatggattttgtatttgatcgcatgttcacaaatccgcgggactcttatgggaagccactggtgaaggaccgggaagctgagcttctgtactttgctgatgtctgcgcaggcccaggtggcttctcagagtatgtgctgtggaggaagaagtggcatgcaaagggctttggaatgactttgaagggccctaatgacttcaagctggaggacttctactctgcttccagtgaactcttcgaaccctactatggtgagggtgggattgatggagatggagatatcacccgcccagagaacatctctgcttttcggaattttgtcctggataacacagatcgcaagggtgtccattttctgatggctgatgggggtttctcggtggaggggcaggagaacctgcaggagatcctcagcaagcagctgcttctgtgtcagttcctcatggcgctgtccattgtccggacaggaggccacttcatctgtaaaacctttgacctgttcacaccgtttagtgtggggcttgtctacctgctgtactgctgctttgaacgagtttgtctcttcaagcctattaccagccgtcctgccaactcagagaggtatgtggtgtgcaagggcctgaaggtgggcatagatgatgttcgggattacctcttcgcagtgaatattaaactcaatcagctgcggaacacggattccgacgtcaacttggtggtccccctggaggtgatcaagggagaccatgaatttactgactacatgatacggtccaatgagagccactgtagtctgcagatcaaagctctggcgaaaatccatgcctttgttcaagacacgacactgagtgagcctcgacaggcagagatacggaaggagtgcctccgactctgggggatcccagaccaggctcgtgtggctccttcttcctccgaccctaaatcgaagttctttgagctaatccagggcactgagattgacatcttcagctacaagcccacactgctcacctctaaaaccctggagaagatccgccctgtgtttgactaccgctgcatggtatctggcagtgagcagaagttcctcatcggcctggggaaatcccagatctacacatgggatggccgccagtcagaccgctggatcaagctagacctgaagacagagctgccccgggacactctgctatctgtggaaattgtgcatgagctgaaaggggaggggaaggcccagaggaagatcagtgccatccacatcctcgatgtccttgtgctgaatggcaccgacgttcgggagcagcactttaaccagcggtctgacctgggccccagggtagggagggtgggggtaggccagggcagcttgggaggacagcggcctcccgaggtgtggccccttatctaggccttctctgcttgttgacatcctgagagtttccccctcccacccactgactggtcccaaagtcagggtgagaattggagttgccacttcagagtttgctagggcttgggccctggttatcagagataccagcacactccattttgccacagctgctcaggttgaggtatttatgttaaggttgagcaagagggtgaccttgcgggtagagggggtactccttggaagaaatatcctgtgcttgagtggtcccatttaagttgctcatctgagtgggtgcactgtagtttccatgctttggggtgacagggcagacacatacaataaagatgatacttgaagttctagtggaggtgactgagcacagctgaaggcacacttcaggaaaaccaaccgacatagtgaaattagagaattcagcttgccgagaaatttgtgaaagccgtttccaagcctagtcggcccgacatgaatcccatcagggtgaaggaggtgtacagactggaagagatggagaagatttttgtcaggttggagatgaagatcatcaagggctccagtggcaccccaaagctcagctacacagggcgtgatgaccggcactttgtacccatgggcctctacatcgtcaggacagtgaatgagccctggactatgggattcagcaaaagcttcaagaagaagttcttctacaacaagaaaaccaaggactctacttttgacctccctgcagactccattgccccatttcacatttgctactatggccggctcttctgggagtggggggatggcattcgtgtgcatgactcccagaagccccaggaccaggacaagctgtccaaggaggacgtcctctccttcatccagatgcacagggcctaagagcctcagaatgtgccacccctgcagaatgccctgtcattcctgagatggggccacctggggcccacagtggtggcttcttccccctcttgaaaagggactggggagcattgcacctggcatgaggagtgggtggcctcctctccatcccctgaagagctcaggcagggccctgcagagaacactcatgttccttctgggacacctgcctgggaactttcccctgccaggactcagcctgaaggaagctgctcctgaggcaggtatgaggtcagtgcctagggcacgtgggactgatggaggacatatcagagtggcagagctgtgggctctgctgttctctcctgcatcctgtagactcacttttctgagttccatgcactgccctgagggtagccatgcccttgctttgcccaactttttattgggccatccctgagtgggtggagacctgctgtcatgagctggccaggagaacctgctataaaaaaatcaaggttttgtttctttgaacttactctgttttgatgccaaattggagaccattttcttgtctccttcccccactcatcctggccttccctggagttcttcctagcccagagctctgacagtccagcagggtgggaaggagggagtttgggcaaactctcatccctgataccacattgagatcctgggagccctcttttcgtactgagtatggagttgtagagccatcctaggtgccatccccttttggtccaaacattgggcagcgctagatggcaggaagcagccttgaagacccgtctttcccccacagcagcaggggccccagcagtaacaaagggtacctccaggggtttgggtagcgctgccctctggcagtcatgcaccgctgtctgccatagccgctctagggtcttggcagaattctgagcttgaagtgcagctcccttactaccctttcccttcctttttcttccctaataggaggtacaatctgcttttgtttgtcgttaagtggtcactcccatttcctttatcttggccgacaacacagagaggagggggagctgggcagtagcttggggtgggggtgggcacctgtggttgtttttaatgggaaatacctctcagagatgttcatgcaggctccctagggccccatcccagtgccaggctggtttccatggagatagggcactgaggctcccgtgaggttggaatcgacttcaccatgggggtccttcagccagcatccagctccccacccccaggctggcagtagcactgctgagatgctgtatttccacccaattctgggtatatcagtgtgtcttgcagaatcttggatcattaaagataaacatatttttaa

SEQ ID NO: 307566 - DNA, 2787 bp, Homo sapiens
atgcctcataatttttttattaaatgccagacattgtgtgtaaagaacagtgaagactaaagtagaaagggtggctgttagtatacataggtcgagtaagcttagtctatagttgaactgaatctgggctttgaatgagctcaccactactttcagattatttaagggtgggattagaagcttccttttagtaggacttgggatctaagaactgagtgacccagttttcctgttctaccctcatccttcagtaagccccacataactgcactgtggggtaggggtgtgggtttctttctcaactctccagctccttcaccaaatatagatggccactgctcccgtttaacctctctgtcctgatgtcagttacctgtcttttttggtaatcctgagatcaaataatttttttttcttctagccactgtagtctgcagatcaaagctctggcgaaaatccatgcctttgttcaagacacgacactgagtgagcctcgacaggcagagatacggaaggagtgcctccgactctgggggatcccagaccaggctcgtgtggctccttcttcctccgaccctaaatcgaagttctttgagctaatccagggcactgagattgacatcttcagctacaagcccacactgctcacctctaaaaccctggagaagatccgccctgtgtttgactaccgctgcatggtatctggcagtgagcagaagttcctcatcggcctggggaaatcccagatctacacatgggatggccgccagtcagaccgctggatcaagctagacctgaagacagagctgccccgggacactctgctatctgtggaaattgtgcatgagctgaaaggggaggggaaggcccagaggaagatcagtgccatccacatcctcgatgtccttgtgctgaatggcaccgacgttcgggagcagcactttaaccagcgaattcagcttgccgagaaatttgtgaaagccgtttccaagcctagtcggcccgacatgaatcccatcagggtgaaggaggtgtacagactggaagagatggagaagatttttgtcaggttggagatgaagatcatcaagggctccagtggcaccccaaagctcagctacacagggcgtgatgaccggcactttgtacccatgggcctctacatcgtcaggacagtgaatgagccctggactatgggattcagcaaaagcttcaagaagaagttcttctacaacaagaaaaccaaggactctacttttgacctccctgcagactccattgccccatttcacatttgctactatggccggctcttctgggagtggggggatggcattcgtgtgcatgactcccagaagccccaggaccaggacaagctgtccaaggaggacgtcctctccttcatccagatgcacagggcctaagagcctcagaatgtgccacccctgcagaatgccctgtcattcctgagatggggccacctggggcccacagtggtggcttcttccccctcttgaaaagggactggggagcattgcacctggcatgaggagtgggtggcctcctctccatcccctgaagagctcaggcagggccctgcagagaacactcatgttccttctgggacacctgcctgggaactttcccctgccaggactcagcctgaaggaagctgctcctgaggcaggtatgaggtcagtgcctagggcacgtgggactgatggaggacatatcagagtggcagagctgtgggctctgctgttctctcctgcatcctgtagactcacttttctgagttccatgcactgccctgagggtagccatgcccttgctttgcccaactttttattgggccatccctgagtgggtggagacctgctgtcatgagctggccaggagaacctgctataaaaaaatcaaggttttgtttctttgaacttactctgttttgatgccaaattggagaccattttcttgtctccttcccccactcatcctggccttccctggagttcttcctagcccagagctctgacagtccagcagggtgggaaggagggagtttgggcaaactctcatccctgataccacattgagatcctgggagccctcttttcgtactgagtatggagttgtagagccatcctaggtgccatccccttttggtccaaacattgggcagcgctagatggcaggaagcagccttgaagacccgtctttcccccacagcagcaggggccccagcagtaacaaagggtacctccaggggtttgggtagcgctgccctctggcagtcatgcaccgctgtctgccatagccgctctagggtcttggcagaattctgagcttgaagtgcagctcccttactaccctttcccttcctttttcttccctaataggaggtacaatctgcttttgtttgtcgttaagtggtcactcccatttcctttatcttggccgacaacacagagaggagggggagctgggcagtagcttggggtgggggtgggcacctgtggttgtttttaatgggaaatacctctcagagatgttcatgcaggctccctagggccccatcccagtgccaggctggtttccatggagatagggcactgaggctcccgtgaggttggaatcgacttcaccatgggggtccttcagccagcatccagctccccacccccaggctggcagtagcactgctgagatgctgtatttccacccaattctgggtatatcagtgtgtcttgcagaatcttggatcattaaagataaacatatttttaa

SEQ ID NO: 307567 - DNA, 3973 bp, Homo sapiens
  misc_feature (5)..(5): n is a, c, g, or t
  misc_feature (8)..(8): n is a, c, g, or t
tgccngcngtactggacccgagcgcgacggtgcggctggcggacccgggctggcttgtggggaaacgaaactgagggaggaggcggcggctctggcagcggcggcgacagtgtcggcctgaccccccctccgctccccggcagctcgctctctcccctcagcttaacgatgaagaggagaactgacccagaatgcactgcccccatcaagaaacagaaaaaaagagttgcagagcttgccctgagcctcagctccacgtccgatgatgaacctccctcctctgtcagtcatggagcaaaagcatctactacaagccttagtgggtctgatagtgagaccgaggggaaacaacacagctctgactcttttgacgatgcattcaaagcagactctcttgtggaaggaacttcttctcgctattccatgtataatagcgtctcccagaagcttatggccaagatgggcttcagggaaggtgaaggattgggtaaatacagccagggtcggaaggacatcgttgaggcttccagtcagaaaggtcgaagaggcttgggtctgacactccggggctttgaccaggagctgaacgtggactggcgagatgagccagagcccagtgcttgtgagcaggtgtcatggtttccagaatgtaccactgaaattcctgacactcaggaaatgagcgattggatggtggtgggaaagagaaagatgattattgaagatgaaacagagttttgtggggaagagctgcttcacagtgtgttgcagtgtaagagcgtgtttgatgtcttggatggggaagagatgcggcgagctcggactcgggccaatccctatgagatgatccgaggagtcttctttctaaacagggcagcaatgaagatggctaacatggattttgtatttgatcgcatgttcacaaatccgcgggactcttatgggaagccactggtgaaggaccgggaagctgagcttctgtactttgctgatgtctgcgcaggcccaggtggcttctcagagtatgtgctgtggaggaagaagtggcatgcaaagggctttggaatgactttgaagggccctaatgacttcaagctggaggacttctactctgcttccagtgaactcttcgaaccctactatggtgagggtgggattgatggagatggagatatcacccgcccagagaacatctctgcttttcggaattttgtcctggataacacagatcgcaagggtgtccattttctgatggctgatgggggtttctcggtggaggggcaggagaacctgcaggagatcctcagcaagcagctgcttctgtgtcagttcctcatggcgctgtccattgtccggacaggaggccacttcatctgtaaaacctttgacctgttcacaccgtttagtgtggggcttgtctacctgctgtactgctgctttgaacgagtttgtctcttcaagcctattaccagccgtcctgccaactcagagaggtatgtggtgtgcaagggcctgaaggtgggcatagatgatgttcgggattacctcttcgcagtgaatattaaactcaatcagctgcggaacacggattccgacgtcaacttggtggtccccctggaggtgatcaagggagaccatgaatttactgactacatgatacggtccaatgagagccactgtagtctgcagatcaaagctctggcgaaaatccatgcctttgttcaagacacgacactgagtgagcctcgacaggcagagatacggaaggagtgcctccgactctgggggatcccagaccaggctcgtgtggctccttcttcctccgaccctaaatcgaagttctttgagctaatccagggcactgagattgacatcttcagctacaagcccacactgctcacctctaaaaccctggagaagatccgccctgtgtttgactaccgctgcatggtatctggcagtgagcagaagttcctcatcggcctggggaaatcccagatctacacatgggatggccgccagtcagaccgctggatcaagctagacctgaagacagagctgccccgggacactctgctatctgtggaaattgtgcatgagctgaaaggggaggggaaggcccagaggaagatcagtgccatccacatcctcgatgtccttgtgctgaatggcaccgacgttcgggagcagcactttaaccagcgaattcagcttgccgagaaatttgtgaaagccgtttccaagcctagtcggcccgacatgaatcccatcagggtgaaggaggtgtacagactggaagagatggagaagatttttgtcaggttggagatgaagatcatcaagggctccagtggcaccccaaagctcagctacacagggcgtgatgaccggcactttgtacccatgggcctctacatcgtcaggacagtgaatgagccctggactatgggattcagcaaaagcttcaagaagaagttcttctacaacaagaaaaccaaggactctacttttgacctccctgcagactccattgccccatttcacatttgctactatggccggctcttctgggagtggggggatggcattcgtgtgcatgactcccagaagccccaggaccaggacaagctgtccaaggaggacgtcctctccttcatccagatgcacagggcctaagagcctcagaatgtgccacccctgcagaatgccctgtcattcctgagatggggccacctggggcccacagtggtggcttcttcccctgaagagctcaggcagggccctgcagagaacactcatgttccttctgggacacctgcctgggaactttcccctgccaggactcagcctgaaggaagctgctcctgaggcaggtatgaggtcagtgcctagggcacgtgggactgatggaggacatatcagagtggcagagctgtgggctctgctgttctctcctgcatcctgtagactcacttttctgagttccatgcactgccctgagggtagccatgcccttgctttgcccaactttttattgggccatccctgagtgggtggagacctgctgtcatgagctggccaggagaacctgctataaaaaaatcaaggttttgtttctttgaacttactctgttttgatgccaaattggagaccattttcttgtctccttcccccactcatcctggccttccctggagttcttcctagcccagagctctgacagtccagcagggtgggaaggagggagtttgggcaaactctcatccctgataccacattgagatcctgggagccctcttttcgtactgagtatggagttgtagagccatcctaggtgccatccccttttggtccaaacattgggcagcgctagatggcaggaagcagccttgaagacccgtctttcccccacagcagcaggggccccagcagtaacaaagggtacctccaggggtttgggtagcgctgccctctggcagtcatgcaccgctgtctgccatagccgctctagggtcttggcagaattctgagcttgaagtgcagctcccttactaccctttcccttcctttttcttccctaataggaggtacaatctgcttttgtttgtcgttaagtggtcactcccatttcctttatcttggccgacaacacagagaggagggggagctgggcagtagcttggggtgggggtgggcacctgtggttgtttttaatgggaaatacctctcagagatgttcatgcaggctccctagggccccatcccagtgccaggctggtttccatggagatagggcactgaggctcccgtgaggttggaatcgacttcaccatgggggtccttcagccagcatccagctccccacccccaggctggcagtagcactgctgagatgctgtatttccacccaattctgggtatatcagtgtgtcttgcagaatcttggatcattaaagataaacatatttttaa

SEQ ID NO: 307568 - DNA, 1902 bp, Homo sapiens
cagcgtcgtattcaaaaacaatcgggttaggtagcgaggcatgggtgtgtcagcactttaaccagcgaattcagcttgccgagaaatttgtgaaagccgtttccaagcctagtcggcccgacatgaatcccatcagggtgaaggaggtgtacagactggaagagatggagaagatttttgtcaggttggagatgaagatcatcaagggctccagtggcaccccaaagctcagctacacagggcgtgatgaccggcactttgtacccatgggcctctacatcgtcaggacagtgaatgagccctggactatgggattcagcaaaagcttcaagaagaagttcttctacaacaagaaaaccaaggactctacttttgacctccctgcagactccattgccccatttcacatttgctactatggccggctcttctgggagtggggggatggcattcgtgtgcatgactcccagaagccccaggaccaggacaagctgtccaaggaggacgtcctctccttcatccagatgcacagggcctaagagcctcagaatgtgccacccctgcagaatgccctgtcattcctgagatggggccacctggggcccacagtggtggcttcttccccctcttgaaaagggactggggagcattgcacctggcatgaggagtgggtggcctcctctccatcccctgaagagctcaggcagggccctgcagagaacactcatgttccttctgggacacctgcctgggaactttcccctgccaggactcagcctgaaggaagctgctcctgaggcaggtatgaggtcagtgcctagggcacgtgggactgatggaggacatatcagagtggcagagctgtgggctctgctgttctctcctgcatcctgtagactcacttttctgagttccatgcactgccctgagggtagccatgcccttgctttgcccaactttttattgggccatccctgagtgggtggagacctgctgtcatgagctggccaggagaacctgctataaaaaaatcaaggttttgtttctttgaacttactctgttttgatgccaaattggagaccattttcttgtctccttcccccactcatcctggccttccctggagttcttcctagcccagagctctgacagtccagcagggtgggaaggagggagtttgggcaaactctcatccctgataccacattgagatcctgggagccctcttttcgtactgagtatggagttgtagagccatcctaggtgccatccccttttggtccaaacattgggcagcgctagatggcaggaagcagccttgaagacccgtctttcccccacagcagcaggggccccagcagtaacaaagggtacctccaggggtttgggtagcgctgccctctggcagtcatgcaccgctgtctgccatagccgctctagggtcttggcagaattctgagcttgaagtgcagctcccttactaccctttcccttcctttttcttccctaataggaggtacaatctgcttttgtttgtcgttaagtggtcactcccatttcctttatcttggccgacaacacagagaggagggggagctgggcagtagcttggggtgggggtgggcacctgtggttgtttttaatgggaaatacctctcagagatgttcatgcaggctccctagggccccatcccagtgccaggctggtttccatggagatagggcactgaggctcccgtgaggttggaatcgacttcaccatgggggtccttcagccagcatccagctccccacccccaggctggcagtagcactgctgagatgctgtatttccacccaattctgggtatatcagtgtgtcttgcagaatcttggatcattaaagataaacatatttttaa

SEQ ID NO: 307569 - DNA, 2943 bp, Homo sapiens
  misc_feature (5)..(5): n is a, c, g, or t
  misc_feature (8)..(8): n is a, c, g, or t
tgccngcngtactggacccgagcgcgacggtgcggctggcggacccgggctggcttgtggggaaacgaaactgagggaggaggcggcggctctggcagcggcggcgacagtgtcggcctgaccccccctccgctccccggcagctcgctctctcccctcagcttaacgatgaagaggagaactgacccagaatgcactgcccccatcaagaaacagaaaaaaagagttgcagagcttgccctgagcctcagctccacgtccgatgatgaacctccctcctctgtcagtcatggagcaaaagcatctactacaagccttagtgggtctgatagtgagaccgaggggaaacaacacagctctgactcttttgacgatgcattcaaagcagactctcttgtggaaggaacttcttctcgctattccatgtataatagcgtctcccagaagcttatggccaagatgggcttcagggaaggtgaaggattgggtaaatacagccagggtcggaaggacatcgttgaggcttccagtcagaaaggtcgaagaggcttgggtctgacactccggggctttgaccaggagctgaacgtggactggcgagatgagccagagcccagtgcttgtgagcaggtgtcatggtttccagaatgtaccactgaaattcctgacactcaggaaatgagcgattggatggtggtgggaaagagaaagatgattattgaagatgaaacagagttttgtggggaagagctgcttcacagtgtgttgcagtgtaagagcgtgtttgatgtcttggatggggaagagatgcggcgagctcggactcgggccaatccctatgagatgatccgaggagtcttctttctaaacagggcagcaatgaagatggctaacatggattttgtatttgatcgcatgttcacaaatccgcgggactcttatgggaagccactggtgaaggaccgggaagctgagcttctgtactttgctgatgtctgcgcaggcccaggtggcttctcagagtatgtgctgtggaggaagaagtggcatgcaaagggctttggaatgactttgaagggccctaatgacttcaagctggaggacttctactctgcttccagtgaactcttcgaaccctactatggtgagggtgggattgatggagatggagatatcacccgcccagagaacatctctgcttttcggaattttgtcctggataacacagatcgcaagggtgtccattttctgatggctgatgggggtttctcggtggaggggcaggagaacctgcaggagatcctcagcaagcagctgcttctgtgtcagttcctcatggcgctgtccattgtccggacaggaggccacttcatctgtaaaacctttgacctgttcacaccgtttagtgtggggcttgtctacctgctgtactgctgctttgaacgagtttgtctcttcaagcctattaccagccgtcctgccaactcagagaggtatgtggtgtgcaagggcctgaaggtgggcatagatgatgttcgggattacctcttcgcagtgaatattaaactcaatcagctgcggaacacggattccgacgtcaacttggtggtccccctggaggtgatcaagggagaccatgaatttactgactacatgatacggtccaatgagagccactgtagtctgcagatcaaagctctggcgaaaatccatgcctttgttcaagacacgacactgagtgagcctcgacaggcagagatacggaaggagtgcctccgactctgggggatcccagaccaggctcgtgtggctccttcttcctccgaccctaaatcgaagttctttgagctaatccagggcactgagattgacatcttcagctacaagcccacactgctcacctctaaaaccctggagaagatccgccctgtgtttgactaccgctgcatggtatctggcagtgagcagaagttcctcatcggcctggggaaatcccagatctacacatgggatggccgccagtcagaccgctggatcaagctagacctgaagacagagctgccccgggacactctgctatctgtggaaattgtgcatgagctgaaaggggaggggaaggcccagaggaagatcagtgccatccacatcctcgatgtccttgtgctgaatggcaccgacgttcgggagcagcactttaaccagcgaattcagcttgccgagaaatttgtgaaagccgtttccaagcctagtcggcccgacatgaatcccatcagggtgaaggaggtgtacagactggaagagatggagaagatttttgtcaggttggagatgaagatcatcaagggctccagtggcaccccaaagctcagctacacagggcgtgatgaccggcactttgtacccatgggcctctacatcgtcaggacagtgaatgagccctggactatgggattcagcaaaagcttcaagaagaagttcttctacaacaagaaaaccaaggactctacttttgacctcccttactaccctttcccttcctttttcttccctaataggaggtacaatctgcttttgtttgtcgttaagtggtcactcccatttcctttatcttggccgacaacacagagaggagggggagctgggcagtagcttggggtgggggtgggcacctgtggttgtttttaatgggaaatacctctcagagatgttcatgcaggctccctagggccccatcccagtgccaggctggtttccatggagatagggcactgaggctcccgtgaggttggaatcgacttcaccatgggggtccttcagccagcatccagctccccacccccaggctggcagtagcactgctgagatgctgtatttccacccaattctgggtatatcagtgtgtcttgcagaatcttggatcattaaagataaacatatttttaa

SEQ ID NO: 307570 - DNA, 2905 bp, Homo sapiens
  misc_feature (5)..(5): n is a, c, g, or t
  misc_feature (8)..(8): n is a, c, g, or t
tgccngcngtactggacccgagcgcgacggtgcggctggcggacccgggctggcttgtggggaaacgaaactgagggaggaggcggcggctctggcagcggcggcgacagtgtcggcctgaccccccctccgctccccggcagctcgctctctcccctcagcttaacgatgaagaggagaactgacccagaatgcactgcccccatcaagaaacagaaaaaaagagttgcagagcttgccctgagcctcagctccacgtccgatgatgaacctccctcctctgtcagtcatggagcaaaagcatctactacaagccttagtgggtctgatagtgagaccgaggggaaacaacacagctctgactcttttgacgatgcattcaaagcagactctcttgtggaaggaacttcttctcgctattccatgtataatagcgtctcccagaagcttatggccaagatgggcttcagggaaggtgaaggattgggtaaatacagccagggtcggaaggacatcgttgaggcttccagtcagaaaggtcgaagaggcttgggtctgacactccggggctttgaccaggagctgaacgtggactggcgagatgagccagagcccagtgcttgtgagcaggtgtcatggtttccagaatgtaccactgaaattcctgacactcaggaaatgagcgattggatggtggtgggaaagagaaagatgattattgaagatgaaacagagttttgtggggaagagctgcttcacagtgtgttgcagtgtaagagcgtgtttgatgtcttggatggggaagagatgcggcgagctcggactcgggccaatccctatgagatgatccgaggagtcttctttctaaacagggcagcaatgaagatggctaacatggattttgtatttgatcgcatgttcacaaatccgcgggactcttatgggaagccactggtgaaggaccgggaagctgagcttctgtactttgctgatgtctgcgcaggcccaggtggcttctcagagtatgtgctgtggaggaagaagtggcatgcaaagggctttggaatgactttgaagggccctaatgacttcaagctggaggacttctactctgcttccagtgaactcttcgaaccctactatggtgagggtgggattgatggagatggagatatcacccgcccagagaacatctctgcttttcggaattttgtcctggataacacagatcgcaagggtgtccattttctgatggctgatgggggtttctcggtggaggggcaggagaacctgcaggagatcctcagcaagcagctgcttctgtgtcagttcctcatggcgctgtccattgtccggacaggaggccacttcatctgtaaaacctttgacctgttcacaccgtttagtgtggggcttgtctacctgctgtactgctgctttgaacgagtttgtctcttcaagcctattaccagccgtcctgccaactcagagaggtatgtggtgtgcaagggcctgaaggtgggcatagatgatgttcgggattacctcttcgcagtgaatattaaactcaatcagctgcggaacacggattccgacgtcaacttggtggtccccctggaggtgatcaagggagaccatgaatttactgactacatgatacggtccaatgagagccactgtagtctgcagatcaaagctctggcgaaaatccatgcctttgttcaagacacgacactgagtgagcctcgacaggcagagatacggaaggagtgcctccgactctgggggatcccagaccaggctcgtgtggctccttcttcctccgaccctaaatcgaagttctttgagctaatccagggcactgagattgacatcttcagctacaagcccacactgctcacctctaaaaccctggagaagatccgccctgtgtttgactaccgctgcatggtatctggcagtgagcagaagttcctcatcggcctggggaaatcccagatctacacatgggatggccgccagtcagaccgctggatcaagctagacctgaagacagagctgccccgggacactctgctatctgtggaaattgtgcatgagctgaaaggggaggggaaggcccagaggaagatcagtgccatccacatcctcgatgtccttgtgctgaatggcaccgacgttcgggagcagcactttaaccagcgaattcagcttgccgagaaatttgtgaaagccgtttccaagcctagtcggcccgacatgaatcccatcagggtgaaggaggtgtacagactggaagagatggagaagatttttgtcaggttggagatgaagatcatcaagggctccagtggcaccccaaagctcagctacacagggcgtgatgaccggcactttgtacccatgggcctctacatcgtcaggacagtgaatgagccctggactatgggattcagcaaaagcttcaagaagaagttcttctacaacaagaaaaccaaggactctacttttgacctccctgcagactccattgccccatttcacctccccagccttgcctgcctgtcgaagatggattaactccgcactcccctgggatcgccacatgaccacttcaagtccccaagccgcccttcgctgcacagactgcatttttttctgccataattacaagcaatggcactgactggagggcatgacagtgtgtggtggggggatggacaggtggcacaatgtctgctgctcaaccccagcagtgcccgagccctggaagtaactcccactatttggcttggaaagtgcttcccactgtctccttcccactcgagctgggggccttctcctctattctgaattgtaatccagagctttcccttgaacatctcttcttccttgattcctgagt

SEQ ID NO: 307571 - DNA, 652 bp, Homo sapiens
  misc_feature (5)..(5): n is a, c, g, or t
  misc_feature (8)..(8): n is a, c, g, or t
tgccngcngtactggacccgagcgcgacggtgcggctggcggacccgggctggcttgtggggaaacgaaactgagggaggaggcggcggctctggcagcggcggcgacagtgtcggcctgaccccccctccgctccccggcagctcgctctctcccctcagcttaacgatgaagaggagaactgacccagaatgcactgcccccatcaagaaacagaaaaaaagagttgcagagcttgccctgagcctcagctccacgtccgatgatgaacctccctcctctgtcagtcatggagcaaaagcatctactacaagccttagtgggtctgatagtgagaccgaggggaaacaacacagctctgactcttttgacgatgcattcaaagcagactctcttgtggaaggaacttcttctcgctattccatgtataatagcgtctcccagaagcttatggccaagatgggcttcagggaaggtgaaggattgggtaaatacagccagggtcggaaggacatcgttgaggcttccagtcagaaaggtcgaagaggcttgggtctgacactccggggctttgaccaggagctgaacgtggactggcgagatgagccagaggtaagtgttaaagtgaggaggagatggaaaagccacttgt

SEQ ID NO: 307572 - DNA, 432 bp, Homo sapiens
ccttcagggattgatgtttcttggcagagaaccaagtcccttcttgctctacttacttggaaccctaatttcttcattcatccccgacaattgcagtcacacgtggtcattacttactgcttttttctccctgtagagaaagatgattattgaagatgaaacagagttttgtggggaagagctgcttcacagtgtgttgcagtgtaaggtaaggtcttgtggctagaaccagataatgaaaaccttgtgggaggtgatttgctggacttttccatttctcctttgagtgggttgtgggaagctaaagttaagatttttgctggagatcagatgcatagcttggttcatatctgcaaattgtctttttcctgggtgactgttctgccctgtgggtgttgtgctgtccctgtggtcagcagccaagaaaggatc

SEQ ID NO: 307573 - DNA, 524 bp, Homo sapiens
ggtttctcggtggaggggcaggagaacctgcaggagatcctcagcaagcagctgcttctgtgtcagttcctcatggcgctgtccattgtccggacaggtgacacttcctcagctgtctcctcaccccaggacccacttagaggccctattggacaagaacatgtacaaggggttggtggggaagttaaaaaaatctgcttatattagaggacaggtagctaaatgagtaatttagggaagaaagggctgtggaatcctcaaagtcccctccaaagatggttctcccccttaaattgtctctgagttttaacagacccaggtgctggtttccttgactttgtcatatttactcccaagactacttcacccatctcttggaatagacccattggctgcttttggtgttttctctctaatctaggaggccacttcatctgtaaaacctttgacctgttcacaccgtttagtgtggggcttgtctacctgctgtactgctgctttgaacgagtttgtctcttcaagcc

SEQ ID NO: 307574 - DNA, 458 bp, Homo sapiens
gccctggttatcagagataccagcacactccattttgccacagctgctcaggttgaggtatttatgttaaggttgagcaagagggtgaccttgcgggtagagggggtactccttggaagaaatatcctgtgcttgagtggtcccatttaagttgctcatctgagtgggtgcactgtagtttccatgctttggggtgacagggcagacacatacaataaagatgatacttgaagttctagtggaggtgactgagcacagctgaaggcacacttcaggaaaaccaaccgacatagtgaaattagaggtcagaatccacaggggcggggcatgaataaagacgtcggtggagaagggcagggcgggcttcctgggggacatgggtgctgcctcttagagcagtcttgccgcagattcagaaggttctcctactggagctgtgaaaatgccctgggggtagg

SEQ ID NO: 307575 - DNA, 8055 bp, Homo sapiens
aggcggcgcgcagcggccgaggtggcggcggctgcagctgcggcggcgcgctccgagcctgcgtctagggcgcccccgggtcagagctgtcgccgtggccgccgctgcaaagaacaatgtaccgcaagcagcgctcgctcctccgtttcttcccaccggcctaaagacgacggcgggggcggcccgcgcagcggccgcagctctggctcctcttcaggcccggctcgccgcagctcaccgccgccttccgccctccggctcctcgtcgcggaccccggctcgccgaccccgctcgccctcaaggcaccgcggccgccgggcctcgccgtccccgccacggggtcgtcgcgtctccccgtccccgcctcgggcccgtcgcggctccccgtcgccaccgcggggccgacgactcttcccgccgggcccggccggcttcagaggcagcagccgaggggagtcccgcgccgactatgcccgggacggccgcggagaccatccaggcgacagcggcagccggagacgctctcctggtctgtgttctgactctttggaaaagagcttaaggatcactgttggcaatgaccacttctgtgttagcacaccagaacggcgacggcttagtgatcggctggggtcaccagtggataatctggaagacatggacagggatgacctgactgatgattctgtcttcactcgaagctcccagtgctctcggggtcttgagcgatatatttcccaggaggaagggcctctcagtcccttcttgggacaacttgatgaggactaccgaacaaaagaaactttcctgcatcgatctgattatagtccccatatcagttgtcatgatgagctgttgcggggaacagaacggaatcgagaaaaactcaaaggctactccatacgatctgaagaaaggagccgggaggccaaaagaccccgttatgatgacacagtgaagataaacagcatgggaggggatcacccaagttttacatcaggaactcgcaactatcgacagcgtagaagaagcccaagtcctaggtttctcgaccctgagtttcgagaactggatcttgccagacgaaagcgagaggaagaggaggagcgaagtaggagcttgagtcaggagctggttggagttgatggtggtggtactggctgttccatccctggattgtcaggtgtcctaacagcatcggagccaggatattctttgcatcggcctgaggaagtatctgtgatgcccaagaaatccattttgaagaagcggattgaggtggacataatggagccctccatgcagcttgagagtttttccagcagtaccagctccagccaggatcaccctctctactctgggcacccatcccttccactaagtggtgctattgctgcttttgcctcagagattgaaaacaaggggactatggtagagactgccttgaaggaacctcagggcaacctctaccaatggggtccccttcctgggattcccaaagacaacagtcctctcagagaaaaatttggaagttttctatgccacaaggataatttggatttgaaggctgagggacctgagcgacacacagacttcctgctgccccatgagagagctagccaggatggcagtggtttttcccgcattctgagcatgttggctgattctaccagtacacaggaaaaaaggcgacgtagctttcccgacattgaagatgaggagaaatttctctatggggatgaagaagaggatttaaaggcagaatccgtaccaaagccccttgggagctctgagagtgaagttatgaggcagaaggcaagctccctgccgtcttcagctccagctgtaaagctagaatcactagaagagaccaatccagaatatgcgaagatccatgacttgctcaagacaatagggctggatattggagtagcagagattagtcaattggctgcacgcacccaggaacgacttcatggcaagaagccatcattacgctcctcagctgaccgccgttcctcagttgaccgatacttttcagctgaccactgttcctcagttgaccaccgcttctcagctgaccgctgttcctcagttgaccactgcttctcagctgatcgacgttcctcagatccccacagactagagagcagggaggcacatcatagcaatacccactctccagaggtgtcccatccacacccaccttctcctgtggatccttacctgctcacaaaaaacagccctccattcctaaagtctgaccatccagtgggtcatatttcaggaccagaggtggttggtagtgggtttcagtcatctgttgcagtcaggtgcatgttgccatcagccccatctgccccaattagacttccacacactgctgctttatctcagtttcacatgccaagggcctctcagtttgctgcagctcggatacctccgaactaccagggacctgccattccccctgcctcttttgatgcctataggcactacatggcatatgcagcctccagatggcccatgtatcccacctctcaaccgtcaaaccaccctgtacctgaaccacacaggataatgccaataaccaaacaagctactcgtagccgtcccaatcttcgtgtgatccccactgtgactcctgataagcctaagcagaaagagtctctgcgaggctcaattcctgcggcccaagtgcctgtccaggtgtccattccatcactcataagatataatccagagaagatctctgatgagaagaaccgtgcttcccagaagcaaaaggttattgaagagagggaaaaactaaagaatgaccgggaagcccgccagaagaagatgtactatcttaggaccgagttagagcggcttcataaacaacaaggagaaatgctgcgcaagaaacgaagggagaaggatggccacaaagatcctctcttggtggaggtgagtcggcttcaggataacattatgaaggacattgcagagctacggcaagaggcagaagaggcagaaaagaagcaatctgaactggacaaagtggctcagatcttgggaattaacatcttcgataaatcccagaagtctttaagtgacagtagagagcctacagagaagcctgggaaagcagaaaaatctaagagcccagaaaaagtgtcatcgttctcaaactcctcctccaacaaggaatcaaaagtaaacaatgagaagtttcgtactaagagccccaagcctgccgaaagcccccagtcagccactaagcagttggatcagcccactgctgcttatgagtattatgatgctggcaatcactggtgcaaagactgcaacaccatctgtgggaccatgtttgatttcttcactcatatgcacaataagaagcacacacagacactggatccctacaacagaccttgggcttcaaagacccagagtgaggccaagcaagatgccataaagcgcactgacaagataactgttcctgcaaaaggctctgagtttctggttcccatcagtggattttattgccagctctgtgaggaatttttgggggatccaatttctggggagcaacatgtgaagggtcaccaacacaatgagaaatacaagaaatatgtggatgaaaacccattatatgaggagcggcggaatctggaccgccaagctggcttggctgtggtcctagagacagaacggcgacggcagagtgagctaaagcgcaaacttagtgagaaaccaaaggaggagaagaaagaaaaaaaggcaaaggctgtgaaagaagtaaaggaggatgacaaggtctctgagaaattagaagaccaactctctgagggtaggaactcccctgaaaaagctgaaaataaaaggaacactggcatcaaactccagttaaaagaagaggtaaagaaggaatcaccaacatcatcttcttttgggaaattcagctggaagaagccagaaaaagaagaggagaaaagttcattggtgaccccaagtatctctaaagaagagattctagaaagtagtaaggacaaagaggatggcaaaactgaagctgggaaggcaaagcctatcaaaatcaagctctctgggaaaactgttgttgcacataccagcccttggatgcctgttgtgacaacttccacacagactaagatcggacccaacctgcctattccatccacagtactccgcaagtcatgttcagccacaatgagcaagccagctcctcttaacacctttctgtctattaagtcctctggaaccactgctaaacctctgccagtggttaaagagtcttcagctgatctcctcttacctccagacatcatctccaaagcatttggaggggaagaggtgattctaaaagggtctccagaggaaaaagtggtgttggctgaaaagagtgagccatctcatttacctgaacaaatactaccacctcctccaccacccccacctccaccacctccaccaccccccgttatacctcatccagctgccccgtctgctgctcaagcaaatgctatcttggctccagtaaaatcaaacccagttgtatctcaaactctcagccctggcttcgtgggtcctaacattttgaacccagtgttgcctgtagccatcatggcctcagcacagccagctgccattccttctgatgagacagctcctggggtgagtgagagtgaccgagaccagaccctgttctctgtgttagtacgtcctccaccacccctctcaagtgtgttcagtgaacaagccaaaaaattagagaagcgaaattcatgcttagccacagccaatgctaaggacctgtatgacatattctatagtagtggtggaaagggggcccctgagactaagggggcccctgagactaagctaagtggtggtccattggccaatggggaaaatagcaacctctctagaaccaaaagttcagacacctcttctacttctcctttgaacagcagtgcatcccaagaggagttgcatcaagatgagggtttggtcgctgctcctatagttagcaactctgaaaagcccattgcaaaaactctggtggccctagggaaatggtcagttgtagaacatgtaggcccaaaaagcacaggcagcacctatggcttcctacagcctctgacaaggttgtgccaaagcaggccttatgaaacaattaccccaaagacagacactttggccatatggacctctagttccttccagagtgacactagtagggatatatctccagagaagagtgagcttgacctgggagagccaggaccacctggtgtagaaccacctcctcaactgttagatatacagtgcaaagaatctcagaagttggtagaaatccacctcagagaatctgttaaccaggataaggaaagccaagagctccgtaaatctgaggattgtagagaaagtgagatagagacaaacactgaactaaaagaaagggtaaaggagctgtctgaggggatagttgatgagggagcaagtaccagcattggaccccacagcatagatgattctaatttgaaccatggaaacagatacatgtgggagggagaagtaaaacagcccaacttgctaatgattgacaaagaggctgaacagtccaataaattgatgacaggaagtgaaactccaagtaaagtagtgatcaaattgagtccacaggcttgctctttcacaaaggcaaaattagactcatttttatcagaagctaggtctttactcaacccacaagatacacctgtgaaaatttctgccccagagttgctgcttcattccccagccagatcagctatgtgtttaacaggtagtccacaagagcaaggagtttcagttgttagtgaggaggggctagagaattcagctccagaatcagcttctagaacttctaggtacagaagtctcaaactcaagagagaaagatcaaaagactttcaagttaaaaagatctatgagttggctgtttgggatgaaaacaagaagaggccagagacctgggagagcccagagaaaccaaaaacagaagcactggagctacaagatgtccatccagagttaacagtgacaatagaaagcaaggccctagaagactttgaagctacagacttaaaggtagaggagcttactgccctggggaatctgggggatatgcctgttgatttctgcactactcgggtaagcccagcacatagatccccaactgtcttgtgtcagaaagtgtgtgaagaaaattctgtatcacctatagggtgtaattcctccgatcccgctgacttcgaaccaatcccatctttttctgggtttccgttagattctcccaaaaccttggtgcttgactttgagacagagggtgaacgaaactcacctaatcccaggagtgttaggatcccttctcctaacattttgaaaactggacttacagaaaatgttgaccgtggcttggggggcctagagggaacacaccaggcccttgacctgttagcaggaggaatgatgcctgaggaagtaaaagaatcttcccaattagacaaacaagagtcactcggattggaattaaaaacaattaattctgcaggccttgggccatctccttgccttccagaccttgttgactttgtcacacggacctctggagttcaaaaagataaactgtgttctccactctctgagccaggtgacccttctaaatgtagttccctggagttggggccattacagctagaaatatcgaatgcatccaccacagaggtggcaattctgcaagtagatgatgacagtggcgaccctctgaatttggttaaagctccagtgtcaaggtcccctccaagggagcaggtaattgaagacaatatggtccctcagggaatgcctgaacaggaaactacagttggtgccatccaggaccacacagaatccagtgttcacaactaagaataaatacctagagctacttgtgagtgaatcattggcttctagaaatcagatgcccagatgatccaagactagtttgttatctcatctggaacctacaccaagagatgcagtcagcatcttaaagtaaatgttcatggaagctaaaaaatttacctcctttccttttccctttccccttaaaacaccagacaaatcgataacaacttatatataatatatatatatctgtaaaaatgtattttgttaatttttttggccaatttattttctcccactttgtcattaaaatcacatgtctaactggctcaccacatagtgtgctttgattgtattttggctttgactctgccatttctgaaatgtgggggaggatggaggcagctgacctctccagttgctgtgttgtattcctacccaatttcctgggcagttgatgcatctctgggaaaaacaccagaaagcttgctgaaatggaaaacttggaagaattgttcatctcttaggcttccatttggatgggcctgccttaacattgtttgaaatgcagcgtgagtagctcttttgtttactgtttacaccccttattggcatgtcaactcctgtacttcccttactctgttgcctttcttgagatgcattgtcctgctaacccacaaacctgtttggaaataaacatggaagaatatctggcaggcttacttttagaagacgacaaatcggtaaggcttattcatggttcattgccaggagcagatatgcttttgagatcacttttatttttgaaatggcctttgttcattgtattgtgatccaataacactttgtattaaattgtttagcagccatttgtgttgtgaaggggtagaagatctctgaaacttgtcttgagattgaactcattccctgttccacaaacccatatgtatcctttcctctacctcctcctttcccaattaatttcaaccatagtacgatgtttggggttgtatattttgttaaaaagattaaagaatttatgagttggcttggacaagtttaactttatttttaatgtgttaattacttggaataaatgcattaatctcaaaaaaaaa

SEQ ID NO: 307576 - DNA, 638 bp, Homo sapiens
tactatttctaacagaagacaagtctagattgccttgaattccttgtaagtacagatttttcccctctaggaatcaaaagtaaacaatgagaagtttcgtactaagagccccaagcctgccgaaagcccccagtcagccactaagcagttggatcagcccactgctgcttatgagtattatgatgctggcaatcactggtgcaaagactgcaacaccatctgtgggaccatgtttgatttcttcactcatatgcacaataagaagcacacacaggggcaattccaaaagtcttcagatttccaaaaggaaggactgcagcagacatttctgcccccagaaaggcagggatagaaaccacagaggccacggaaatgatgggtgcccttgtggccagtaggcaatcacctgaaggatctgacttccagaaggtgggtatgactgatgggggtggggataagttgtagagaagatcctgtcattttagctgccaggaaatggtgagttgggtgagtgaatgtgtatattgttgtacctgtagaggatgaacaagattagaatgtacatagagggtatgtattttagacttgccactcctcaccttatttagcattgaataaattattcctgaagtcccata

SEQ ID NO: 307577 - DNA, 593 bp, Homo sapiens
aacgaacagggtgaaaacagaggcagagttacataacgggagaacaaaaggtagaggatgtggagaaagcagagataaaatcagccatattaagatattattttatttcgtctctctgacactctgtccctgctaagtttccacccagccttcctgtaaccaccttcctaaggatgactatggtcacattgttacagactctcacccacttatcttcctttcttttcaggggcaattccaaaagtcttcagatttccaaaaggaaggactgcagcagacatttctgcccccagaaaggcagggatagaaaccacagaggccacggaaatgatgggtgcccttgtggccagtaggcaatcacctgaaggatctgacttccagaaggtgggtatgactgatgggggtggggataagttgtagagaagatcctgtcattttagctgccaggaaatggtgagttgggtgagtgaatgtgtatattgttgtacctgtagaggatgaacaagattagaatgtacatagagggtatgtattttagacttgccactcctcaccttatttagcattgaataaattattcctgaagtcccata

SEQ ID NO: 307578 - DNA, 8519 bp, Homo sapiens
aggcggcgcgcagcggccgaggtggcggcggctgcagctgcggcggcgcgctccgagcctgcgtctagggcgcccccgggtcagagctgtcgccgtggccgccgctgcaaagaacaatgtaccgcaagcagcgctcgctcctccgtttcttcccaccggcctaaagacgacggcgggggcggcccgcgcagcggccgcagctctggctcctcttcaggcccggctcgccgcagctcaccgccgccttccgccctccggctcctcgtcgcggaccccggctcgccgaccccgctcgccctcaaggcaccgcggccgccgggcctcgccgtccccgccacggggtcgtcgcgtctccccgtccccgcctcgggcccgtcgcggctccccgtcgccaccgcggggccgacgactcttcccgccgggcccggccggcttcagaggcagcagccgaggggagtcccgcgccgactatgcccgggacggccgcggagaccatccaggcgacagcggcagccggagacgctctcctggtctgtgttctgactctttggaaaagagcttaaggatcactgttggcaatgaccacttctgtgttagcacaccagaacggcgacggcttagtgatcggctggggtcaccagtggataatctggaagacatggacagggatgacctgactgatgattctgtcttcactcgaagctcccagtgctctcggggtcttgagcgatatatttcccaggaggaagggcctctcagtcccttcttgggacaacttgatgaggactaccgaacaaaagaaactttcctgcatcgatctgattatagtccccatatcagttgtcatgatgagctgttgcggggaacagaacggaatcgagaaaaactcaaaggctactccatacgatctgaagaaaggagccgggaggccaaaagaccccgttatgatgacacagtgaagataaacagcatgggaggggatcacccaagttttacatcaggaactcgcaactatcgacagcgtagaagaagcccaagtcctaggtttctcgaccctgagtttcgagaactggatcttgccagacgaaagcgagaggaagaggaggagcgaagtaggagcttgagtcaggagctggttggagttgatggtggtggtactggctgttccatccctggattgtcaggtgtcctaacagcatcggagccaggatattctttgcatcggcctgaggaagtatctgtgatgcccaagaaatccattttgaagaagcggattgaggtggacataatggagccctccatgcagcttgagagtttttccagcagtaccagctccagccaggatcaccctctctactctgggcacccatcccttccactaagtggtgctattgctgcttttgcctcagagattgaaaacaaggggactatggtagagactgccttgaaggaacctcagggcaacctctaccaatggggtccccttcctgggattcccaaagacaacagtcctctcagagaaaaatttggaagttttctatgccacaaggataatttggatttgaaggctgagggacctgagcgacacacagacttcctgctgccccatgagagagctagccaggatggcagtggtttttcccgcattctgagcatgttggctgattctaccagtacacaggaaaaaaggcgacgtagctttcccgacattgaagatgaggagaaatttctctatggggatgaagaagaggatttaaaggcagaatccgtaccaaagccccttgggagctctgagagtgaagttatgaggcagaaggcaagctccctgccgtcttcagctccagctgtaaagctagaatcactagaagagaccaatccagaatatgcgaagatccatgacttgctcaagacaatagggctggatattggagtagcagagattagtcaattggctgcacgcacccaggaacgacttcatggcaagaagccatcattacgctcctcagctgaccgccgttcctcagttgaccgatacttttcagctgaccactgttcctcagttgaccaccgcttctcagctgaccgctgttcctcagttgaccactgcttctcagctgatcgacgttcctcagatccccacagactagagagcagggaggcacatcatagcaatacccactctccagaggtgtcccatccacacccaccttctcctgtggatccttacctgctcacaaaaaacagccctccattcctaaagtctgaccatccagtgggtcatatttcaggaccagaggtggttggtagtgggtttcagtcatctgttgcagtcaggtgcatgttgccatcagccccatctgccccaattagacttccacacactgctgctttatctcagtttcacatgccaagggcctctcagtttgctgcagctcggatacctccgaactaccagggacctgccattccccctgcctcttttgatgcctataggcactacatggcatatgcagcctccagatggcccatgtatcccacctctcaaccgtcaaaccaccctgtacctgaaccacacaggataatgccaataaccaaacaagctactcgtagccgtcccaatcttcgtgtgatccccactgtgactcctgataagcctaagcagaaagagtctctgcgaggctcaattcctgcggcccaagtgcctgtccaggtgtccattccatcactcataagatataatccagagaagatctctgatgagaagaaccgtgcttcccagaagcaaaaggttattgaagagagggaaaaactaaagaatgaccgggaagcccgccagaagaagatgtactatcttaggaccgagttagagcggcttcataaacaacaaggagaaatgctgcgcaagaaacgaagggagaaggatggccacaaagatcctctcttggtggaggtgagtcggcttcaggataacattatgaaggacattgcagagctacggcaagaggcagaagaggcagaaaagaagcaatctgaactggacaaagtggctcagatcttgggaattaacatcttcgataaatcccagaagtctttaagtgacagtagagagcctacagagaagcctgggaaagcagaaaaatctaagagcccagaaaaagtgtcatcgttctcaaactcctcctccaacaaggaatcaaaagtaaacaatgagaagtttcgtactaagagccccaagcctgccgaaagcccccagtcagccactaagcagttggatcagcccactgctgcttatgagtattatgatgctggcaatcactggtgcaaagactgcaacaccatctgtgggaccatgtttgatttcttcactcatatgcacaataagaagcacacacaggttggtatcctactctctgttattttcactcccaccctcactctcttcaaacttctatacccctatctgcattgcaaagctggaaaaggaaacattctcatatgggcaggagccccagtctgaagagccaagagacaccaacaaaggagacaccatccccagggctcagtccaggggacttggctgtaactaaacaccatgacaagtgtaagtgaggtttctgcctcttttgattccttgagtacctgatttttttgtttcattttacctttttctggtacttgctctaacatgtgtttaccttttccacaggtgatttccattaaaacagttggcagagggggtgggggtgggtagctgggggcttctggtcccctggtcttattatgggggaaaaaaaagagaaaagtgggtcattgagcttttagtgctgttgtgtgagcacctctgcctcttacaaatagacactggatccctacaacagaccttgggcttcaaagacccagagtgaggccaagcaagatgccataaagcgcactgacaagataactgttcctgcaaaaggctctgagtttctggttcccatcagtggattttattgccagctctgtgaggaatttttgggggatccaatttctggggagcaacatgtgaagggtcaccaacacaatgagaaatacaagaaatatgtggatgaaaacccattatatgaggagcggcggaatctggaccgccaagctggcttggctgtggtcctagagacagaacggcgacggcagagtgagctaaagcgcaaacttagtgagaaaccaaaggaggagaagaaagaaaaaaaggcaaaggctgtgaaagaagtaaaggaggatgacaaggtctctgagaaattagaagaccaactctctgagggtaggaactcccctgaaaaagctgaaaataaaaggaacactggcatcaaactccagttaaaagaagaggtaaagaaggaatcaccaacatcatcttcttttgggaaattcagctggaagaagccagaaaaagaagaggagaaaagttcattggtgaccccaagtatctctaaagaagagattctagaaagtagtaaggacaaagaggatggcaaaactgaagctgggaaggcaaagcctatcaaaatcaagctctctgggaaaactgttgttgcacataccagcccttggatgcctgttgtgacaacttccacacagactaagatcggacccaacctgcctattccatccacagtactccgcaagtcatgttcagccacaatgagcaagccagctcctcttaacacctttctgtctattaagtcctctggaaccactgctaaacctctgccagtggttaaagagtcttcagctgatctcctcttacctccagacatcatctccaaagcatttggaggggaagaggtgattctaaaagggtctccagaggaaaaagtggtgttggctgaaaagagtgagccatctcatttacctgaacaaatactaccacctcctccaccacccccacctccaccacctccaccaccccccgttatacctcatccagctgccccgtctgctgctcaagcaaatgctatcttggctccagtaaaatcaaacccagttgtatctcaaactctcagccctggcttcgtgggtcctaacattttgaacccagtgttgcctgtagccatcatggcctcagcacagccagctgccattccttctgatgagacagctcctggggtgagtgagagtgaccgagaccagaccctgttctctgtgttagtacgtcctccaccacccctctcaagtgtgttcagtgaacaagccaaaaaattagagaagcgaaattcatgcttagccacagccaatgctaaggacctgtatgacatattctatagtagtggtggaaagggggcccctgagactaagggggcccctgagactaagctaagtggtggtccattggccaatggggaaaatagcaacctctctagaaccaaaagttcagacacctcttctacttctcctttgaacagcagtgcatcccaagaggagttgcatcaagatgagggtttggtcgctgctcctatagttagcaactctgaaaagcccattgcaaaaactctggtggccctagggaaatggtcagttgtagaacatgtaggcccaaaaagcacaggcagcacctatggcttcctacagcctctgacaaggttgtgccaaagcaggccttatgaaacaattaccccaaagacagacactttggccatatggacctctagttccttccagagtgacactagtagggatatatctccagagaagagtgagcttgacctgggagagccaggaccacctggtgtagaaccacctcctcaactgttagatatacagtgcaaagaatctcagaagttggtagaaatccacctcagagaatctgttaaccaggataaggaaagccaagagctccgtaaatctgaggattgtagagaaagtgagatagagacaaacactgaactaaaagaaagggtaaaggagctgtctgaggggatagttgatgagggagcaagtaccagcattggaccccacagcatagatgattctaatttgaaccatggaaacagatacatgtgggagggagaagtaaaacagcccaacttgctaatgattgacaaagaggctgaacagtccaataaattgatgacaggaagtgaaactccaagtaaagtagtgatcaaattgagtccacaggcttgctctttcacaaaggcaaaattagactcatttttatcagaagctaggtctttactcaacccacaagatacacctgtgaaaatttctgccccagagttgctgcttcattccccagccagatcagctatgtgtttaacaggtagtccacaagagcaaggagtttcagttgttagtgaggaggggctagagaattcagctccagaatcagcttctagaacttctaggtacagaagtctcaaactcaagagagaaagatcaaaagactttcaagttaaaaagatctatgagttggctgtttgggatgaaaacaagaagaggccagagacctgggagagcccagagaaaccaaaaacagaagcactggagctacaagatgtccatccagagttaacagtgacaatagaaagcaaggccctagaagactttgaagctacagacttaaaggtagaggagcttactgccctggggaatctgggggatatgcctgttgatttctgcactactcgggtaagcccagcacatagatccccaactgtcttgtgtcagaaagtgtgtgaagaaaattctgtatcacctatagggtgtaattcctccgatcccgctgacttcgaaccaatcccatctttttctgggtttccgttagattctcccaaaaccttggtgcttgactttgagacagagggtgaacgaaactcacctaatcccaggagtgttaggatcccttctcctaacattttgaaaactggacttacagaaaatgttgaccgtggcttggggggcctagagggaacacaccaggcccttgacctgttagcaggaggaatgatgcctgaggaagtaaaagaatcttcccaattagacaaacaagagtcactcggattggaattaaaaacaattaattctgcaggccttgggccatctccttgccttccagaccttgttgactttgtcacacggacctctggagttcaaaaagataaactgtgttctccactctctgagccaggtgacccttctaaatgtagttccctggagttggggccattacagctagaaatatcgaatgcatccaccacagaggtggcaattctgcaagtagatgatgacagtggcgaccctctgaatttggttaaagctccagtgtcaaggtcccctccaagggagcaggtaattgaagacaatatggtccctcagggaatgcctgaacaggaaactacagttggtgccatccaggaccacacagaatccagtgttcacaactaagaataaatacctagagctacttgtgagtgaatcattggcttctagaaatcagatgcccagatgatccaagactagtttgttatctcatctggaacctacaccaagagatgcagtcagcatcttaaagtaaatgttcatggaagctaaaaaatttacctcctttccttttccctttccccttaaaacaccagacaaatcgataacaacttatatataatatatatatatctgtaaaaatgtattttgttaatttttttggccaatttattttctcccactttgtcattaaaatcacatgtctaactggctcaccacatagtgtgctttgattgtattttggctttgactctgccatttctgaaatgtgggggaggatggaggcagctgacctctccagttgctgtgttgtattcctacccaatttcctgggcagttgatgcatctctgggaaaaacaccagaaagcttgctgaaatggaaaacttggaagaattgttcatctcttaggcttccatttggatgggcctgccttaacattgtttgaaatgcagcgtgagtagctcttttgtttactgtttacaccccttattggcatgtcaactcctgtacttcccttactctgttgcctttcttgagatgcattgtcctgctaacccacaaacctgtttggaaataaacatggaagaatatctggcaggcttacttttagaagacgacaaatcggtaaggcttattcatggttcattgccaggagcagatatgcttttgagatcacttttatttttgaaatggcctttgttcattgtattgtgatccaataacactttgtattaaattgtttagcagccatttgtgttgtgaaggggtagaagatctctgaaacttgtcttgagattgaactcattccctgttccacaaacccatatgtatcctttcctctacctcctcctttcccaattaatttcaaccatagtacgatgtttggggttgtatattttgttaaaaagattaaagaatttatgagttggcttggacaagtttaactttatttttaatgtgttaattacttggaataaatgcattaatctcaaaaaaaaa

SEQ ID NO: 307579 - DNA, 3758 bp, Homo sapiens
aggcggcgcgcagcggccgaggtggcggcggctgcagctgcggcggcgcgctccgagcctgcgtctagggcgcccccgggtcagagctgtcgccgtggccgccgctgcaaagaacaatgtaccgcaagcagcgctcgctcctccgtttcttcccaccggcctaaagacgacggcgggggcggcccgcgcagcggccgcagctctggctcctcttcaggcccggctcgccgcagctcaccgccgccttccgccctccggctcctcgtcgcggaccccggctcgccgaccccgctcgccctcaaggcaccgcggccgccgggcctcgccgtccccgccacggggtcgtcgcgtctccccgtccccgcctcgggcccgtcgcggctccccgtcgccaccgcggggccgacgactcttcccgccgggcccggccggcttcagaggcagcagccgaggggagtcccgcgccgactatgcccgggacggccgcggagaccatccaggcgacagcggcagccggagacgctctcctggtctgtgttctgactctttggaaaagagcttaaggatcactgttggcaatgaccacttctgtgttagcacaccagaacggcgacggcttagtgatcggctggggtcaccagtggataatctggaagacatggacagggatgacctgactgatgattctgtcttcactcgaagctcccagtgctctcggggtcttgagcgatatatttcccaggaggaagggcctctcagtcccttcttgggacaacttgatgaggactaccgaacaaaagaaactttcctgcatcgatctgattatagtccccatatcagttgtcatgatgagctgttgcggggaacagaacggaatcgagaaaaactcaaaggctactccatacgatctgaagaaaggagccgggaggccaaaagaccccgttatgatgacacagtgaagataaacagcatgggaggggatcacccaagttttacatcaggaactcgcaactatcgacagcgtagaagaagcccaagtcctaggtttctcgaccctgagtttcgagaactggatcttgccagacgaaagcgagaggaagaggaggagcgaagtaggagcttgagtcaggagctggttggagttgatggtggtggtactggctgttccatccctggattgtcaggtgtcctaacagcatcggagccaggatattctttgcatcggcctgaggaagtatctgtgatgcccaagaaatccattttgaagaagcggattgaggtggacataatggagccctccatgcagcttgagagtttttccagcagtaccagctccagccaggatcaccctctctactctgggcacccatcccttccactaagtggtgctattgctgcttttgcctcagagattgaaaacaaggggactatggtagagactgccttgaaggaacctcagggcaacctctaccaatggggtccccttcctgggattcccaaagacaacagtcctctcagagaaaaatttggaagttttctatgccacaaggataatttggatttgaaggctgagggacctgagcgacacacagacttcctgctgccccatgagagagctagccaggatggcagtggtttttcccgcattctgagcatgttggctgattctaccagtacacaggaaaaaaggcgacgtagctttcccgacattgaagatgaggagaaatttctctatggggatgaagaagaggatttaaaggcagaatccgtaccaaagccccttgggagctctgagagtgaagttatgaggcagaaggcaagctccctgccgtcttcagctccagctgtaaagctagaatcactagaagagaccaatccagaatatgcgaagatccatgacttgctcaagacaatagggctggatattggagtagcagagattagtcaattggctgcacgcacccaggaacgacttcatggcaagaagccatcattacgctcctcagctgaccgccgttcctcagttgaccgatacttttcagctgaccactgttcctcagttgaccaccgcttctcagctgaccgctgttcctcagttgaccactgcttctcagctgatcgacgttcctcagatccccacagactagagagcagggaggcacatcatagcaatacccactctccagaggtgtcccatccacacccaccttctcctgtggatccttacctgctcacaaaaaacagccctccattcctaaagtctgaccatccagtgggtcatatttcaggaccagaggtggttggtagtgggtttcagtcatctgttgcagtcaggtgcatgttgccatcagccccatctgccccaattagacttccacacactgctgctttatctcagtttcacatgccaagggcctctcagtttgctgcagctcggatacctccgaactaccagggacctgccattccccctgcctcttttgatgcctataggcactacatggcatatgcagcctccagatggcccatgtatcccacctctcaaccgtcaaaccaccctgtacctgaaccacacaggataatgccaataaccaaacaagctactcgtagccgtcccaatcttcgtgtgatccccactgtgactcctgataagcctaagcagaaagagtctctgcgaggctcaattcctgcggcccaagtgcctgtccaggtgtccattccatcactcataagatataatccagagaagatctctgatgagaagaaccgtgcttcccagaagcaaaaggttattgaagagagggaaaaactaaagaatgaccgggaagcccgccagaagaagatgtactatcttaggaccgagttagagcggcttcataaacaacaaggagaaatgctgcgcaagaaacgaagggagaaggatggccacaaagatcctctcttggtggaggtgagtcggcttcaggataacattatgaaggacattgcagagctacggcaagaggcagaagaggcagaaaagaagcaatctgaactggacaaagtggctcagatcttgggaattaacatcttcgataaatcccagaagtctttaagtgacagtagagagcctacagagaagcctgggaaagcagaaaaatctaagagcccagaaaaagtgtcatcgttctcaaactcctcctccaacaaggaatcaaaagtaaacaatgagaagtttcgtactaagagccccaagcctgccgaaagcccccagtcagccactaagcagttggatcagcccactgctgcttatgagtattatgatgctggcaatcactggtgcaaagactgcaacaccatctgtgggaccatgtttgatttcttcactcatatgcacaataagaagcacacacaggggcaattccaaaagtcttcagatttccaaaaggaaggactgcagcagacatttctgcccccagaaaggcagggatagaaaccacagaggccacggaaatgatgggtgcccttgtggccagtaggcaatcacctgaaggatctgacttccagaaggtgggtatgactgatgggggtggggataagttgtagagaagatcctgtcattttagctgccaggaaatggtgagttgggtgagtgaatgtgtatattgttgtacctgtagaggatgaacaagattagaatgtacatagagggtatgtattttagacttgccactcctcaccttatttagcattgaataaattattcctgaagtcccata

SEQ ID NO: 307580 - DNA, 2912 bp, Homo sapiens
aggcggcgcgcagcggccgaggtggcggcggctgcagctgcggcggcgcgctccgagcctgcgtctagggcgcccccgggtcagagctgtcgccgtggccgccgctgcaaagaacaatgtaccgcaagcagcgctcgctcctccgtttcttcccaccggcctaaagacgacggcgggggcggcccgcgcagcggccgcagctctggctcctcttcaggcccggctcgccgcagctcaccgccgccttccgccctccggctcctcgtcgcggaccccggctcgccgaccccgctcgccctcaaggcaccgcggccgccgggcctcgccgtccccgccacggggtcgtcgcgtctccccgtccccgcctcgggcccgtcgcggctccccgtcgccaccgcggggccgacgactcttcccgccgggcccggccggcttcagaggcagcagccgaggggagtcccgcgccgactatgcccgggacggccgcggagaccatccaggcgacagcggcagccggagacgctctcctggtctgtgttctgactctttggaaaagagcttaaggatcactgttggcaatgaccacttctgtgttagcacaccagaacggcgacggcttagtgatcggctggggtcaccagtggataatctggaagacatggacagggatgacctgactgatgattctgtcttcactcgaagctcccagtgctctcggggtcttgagcgatatatttcccaggaggaagggcctctcagtcccttcttgggacaacttgatgaggactaccgaacaaaagaaactttcctgcatcgatctgattatagtccccatatcagttgtcatgatgagctgttgcggggaacagaacggaatcgagaaaaactcaaaggctactccatacgatctgaagaaaggagccgggaggccaaaagaccccgttatgatgacacagtgaagataaacagcatgggaggggatcacccaagttttacatcaggaactcgcaactatcgacagcgtagaagaagcccaagtcctaggtttctcgaccctgagtttcgagaactggatcttgccagacgaaagcgagaggaagaggaggagcgaagtaggagcttgagtcaggagctggttggagttgatggtggtggtactggctgttccatccctggattgtcaggtgtcctaacagcatcggagccaggatattctttgcatcggcctgaggaagtatctgtgatgcccaagaaatccattttgaagaagcggattgaggtggacataatggagccctccatgcagcttgagagtttttccagcagtaccagctccagccaggatcaccctctctactctgggcacccatcccttccactaagtggtgctattgctgcttttgcctcagagattgaaaacaaggggactatggtagagactgccttgaaggaacctcagggcaacctctaccaatggggtccccttcctgggattcccaaagacaacagtcctctcagagaaaaatttggaagttttctatgccacaaggataatttggatttgaaggctgagggacctgagcgacacacagacttcctgctgccccatgagagagctagccaggatggcagtggtttttcccgcattctgagcatgttggctgattctaccagtacacaggaaaaaaggcgacgtagctttcccgacattgaagatgaggagaaatttctctatggggatgaagaagaggatttaaaggcagaatccgtaccaaagccccttgggagctctgagagtgaagttatgaggcagaaggcaagctccctgccgtcttcagctccagctgtaaagctagaatcactagaagagaccaatccagaatatgcgaagatccatgacttgctcaagacaatagggctggatattggagtagcagagattagtcaattggctgcacgcacccaggaacgacttcatggcaagaagccatcattacgctcctcagctgaccgccgttcctcagttgaccgatacttttcagctgaccactgttcctcagttgaccaccgcttctcagctgaccgctgttcctcagttgaccactgcttctcagctgatcgacgttcctcagatccccacagactagagagcagggaggcacatcatagcaatacccactctccagaggtgtcccatccacacccaccttctcctgtggatccttacctgctcacaaaaaacagccctccattcctaaagtctgaccatccagtgggtcatatttcaggaccagaggtggttggtagtgggtttcagtcatctgttgcagtcaggtgcatgttgccatcagccccatctgccccaattagacttccacacactgctgctttatctcagtttcacatgccaagggcctctcagtttgctgcagctcggatacctccgaactaccagggacctgccattccccctgcctcttttgatgcctataggcactacatggcatatgcagcctccagatggcccatgtatcccacctctcaaccgtcaaaccaccctgtacctgaaccacacaggataatgccaataaccaaacaagctactcgtagccgtcccaatcttcgtgtgatccccactgtgactcctgataagcctaagcagaaagagtctctgcgaggctcaattcctgcggcccaagtgcctgtccaggtgtccattccatcactcataagatataatccagagaagatctctgatgagaagaaccgtgcttcccagaagcaaaaggttattgaagagagggaaaaactaaagaatgaccacaaatccaccagaaggaagaaactccaaacacgtctgaacatcagaaagaacaaactccggacataccatctttaagaactgtagcact

SEQ ID NO: 307581 - DNA, 1540 bp, Homo sapiens
aggcggcgcgcagcggccgaggtggcggcggctgcagctgcggcggcgcgctccgagcctgcgtctagggcgcccccgggtcagagctgtcgccgtggccgccgctgcaaagaacaatgtaccgcaagcagcgctcgctcctccgtttcttcccaccggcctaaagacgacggcgggggcggcccgcgcagcggccgcagctctggctcctcttcaggcccggctcgccgcagctcaccgccgccttccgccctccggctcctcgtcgcggaccccggctcgccgaccccgctcgccctcaaggcaccgcggccgccgggcctcgccgtccccgccacggggtcgtcgcgtctccccgtccccgcctcgggcccgtcgcggctccccgtcgccaccgcggggccgacgactcttcccgccgggcccggccggcttcagaggcagcagccgaggggagtcccgcgccgactatgcccgggacggccgcggagaccatccaggcgacagcggcagccggagacgctctcctggtctgtgttctgactctttggaaaagagcttaaggatcactgttggcaatgaccacttctgtgttagcacaccagaacggcgacggcttagtgatcggctggggtcaccagtggataatctggaagacatggacagggatgacctgactgatgattctgtcttcactcgaagctcccagtgctctcggggtcttgagcgatatatttcccaggaggaagggcctctcagtcccttcttgggacaacttgatgaggactaccgaacaaaagaaactttcctgcatcgatctgattatagtccccatatcagttgtcatgatgagctgttgcggggaacagaacggaatcgagaaaaactcaaaggctactccatacgatctgaagaaaggagccgggaggccaaaagaccccgttatgatgacacagtgaagataaacagcatgggaggggatcacccaagttttacatcaggaactcgcaactatcgacagcgtagaagaagcccaagtcctaggtttctcgaccctgagtttcgagaactggatcttgccagacgaaagcgagaggaagaggaggagcgaagtaggagcttgagtcaggagctggttggagttgatggtggtggtactggctgttccatccctggattgtcaggtgtcctaacagcatcggagccaggatattctttgcatcggcctgaggaagtatctgtgatgcccaagaaatccattttgaagaagcggattgaggtggacataatggagccctccatgcaggtctctgctgcatttcttgtagggcctcttgctagtctccctaatatcttaaagcctgcttactttcctgtgggctatgttcctaatggtatctttgtaatatgtgctggaccgacattgtgagctacaccttctaggactctccaaacgaaactgtaggccttttaatgcatcagtagagggttctattgctgtatattaggctttatattaataaatagatattttggagag

SEQ ID NO: 307582 - DNA, 344 bp, Homo sapiens
ccaataaccaaacaagctactcgtagccgtcccaatcttcgtgtgatccccactgtgactcctgataagcctaagcagaaagagtctctgcgaggctcaattcctgcggcccaagtgcctgtccaggtgtccattccatcactcataagatataatccagagaagatctctgatgagaagaaccgtgcttcccagaagcaaaaggtgaatattagctttgggtatcctgtgcctgagttttctgttttgccataaatttgtatatgttttttagaaggggctgaaaatttgtaaggctctttcacttgaagtcgtctggaggctgctgtcatcatcctaagaag

SEQ ID NO: 307583 - DNA, 439 bp, Homo sapiens
cggccgccgggcctcgccgtccccgccacggggtcgtcgcgtctccccgtccccgcctcgggcccgtcgcggctccccgtcgccaccgcggggccgacgactcttcccgccgggcccggccggcttcagaggcagcagccgaggggagtcccgcgccgactatgcccgggacggccgcggagaccatccaggcgacagcggcagccgggtaatcccacccctcgtccaggactccctccatcccccagtcccctcccccggaattcccgtttccagaaacgcccggggcctccagaccagggtcctaagcgcgaagcctccggccaactccctcggggatgccgagcctggaggcttctgtcagacccgggagcgttgacacaataacggactcgggagcgcacgggcgtctcgtcgggagtgcgcgctccgttcctta

SEQ ID NO: 307584 - DNA, 365 bp, Homo sapiens
ttttttaagtcaccttcatactgatttccataacggctatggaaaaacacttgttatcttttgtctttttgatagtagccattctaacctgtgggaggtgatatctcattgtggttttgatttgcatttcccctgataattagagatgttgagcaacttttcgtattcctggtggccttttgaattccttcttttgaggtcctttgtccatttttaaattgctatttgtaatttcggtattaaggtgtatgagtcccttatatatttaggatttaaccccttattgaatatacggtttgcaaatcttttttcctcattccgaatattgtctttacattttgttgattgtttgtcgacgcggccgc

SEQ ID NO: 307585 - DNA, 841 bp, Homo sapiens
ctcccattacttcccgttttctcgatctgctgctcgtctcaggctcgtagttcgccttcaacatgccggaaccagcgaagtccgctcccgcgcccaagaagggctcgaagaaagccgtgactaaggcgcagaagaaggacggcaagaagcgcaagcgcagccgcaaggagagctactccgtatacgtgtacaaggtgctgaagcaggtccaccccgacaccggcatctcctctaaggccatgggaatcatgaactccttcgtcaacgacatcttcgaacgcatcgcgggtgaggcttcccgcctggcgcattacaacaagcgctcgaccatcacctccagggagatccagacggccgtgcgcctgctgctgcccggggagttggccaagcacgccgtgtccgagggcaccaaggccgtcaccaagtacaccagcgctaagtaaacttgccaaggagggactttctctggaatttcctgatatgaccaagaaagcttcttatcaaaagaagcacaattgccttcggttacctcattatctactgcagaaaagaagacgagaatgcaaccatacctagatggacttttccacaagctaaagctggcctcttgatctcattcagattccaaagagaatcatttacaagttaatttctgtctccttggtccattccttctctctaataatcatttactgttcctcaaagaattgtctacattacccatctcctcttttgcctctgagaaagagtatataagcttctgtaccccactggggggttggggtaatattctgtggtcctcagccctgtaccttaataaatttgtatgccttttctctta

SEQ ID NO: 307586 - DNA, 1241 bp, Homo sapiens
ctcccattacttcccgttttctcgatctgctgctcgtctcaggctcgtagttcgccttcaacatgccggaaccagcgaagtccgctcccgcgcccaagaagggctcgaagaaagccgtgactaaggcgcagaagaaggacggcaagaagcgcaagcgcagccgcaaggagagctactccgtatacgtgtacaaggtgctgaagcaggtccaccccgacaccggcatctcctctaaggccatgggaatcatgaactccttcgtcaacgacatcttcgaacgcatcgcgggtgaggcttcccgcctggcgcattacaacaagcgctcgaccatcacctccagggagatccagacggccgtgcgcctgctgctgcccggggagttggccaagcacgccgtgtccgagggcaccaaggccgtcaccaagtacaccagcgctaagtaaacttgccaaggagggactttctctggaatttcctgatatgaccaagaaagcttcttatcaaaagaagcacaattgccttcggttacctcattatctactgcagaaaagaagacgagaatgcaaccatacctagatggacttttccacaagctaaagctggcctcttgatctcattcagattccaaagagaatcatttacaagttaatttctgtctccttggtccattccttctctctaataatcatttactgttcctcaaagaattgtctacattacccatctcctcttttgcctctgagaaagagtatataagcttctgtaccccactggggggttggggtaatattctgtggtcctcagccctgtaccttaataaatttgtatgccttttctcttaaaaaaaaacacaaacccaacccataacgagaaaaaaacgcagcaaaccgaccctacccaaaaaaaatcagcactcccagcgcacacaaacaacaaaagcagaaaccgacaaaagttttccgccccgctggcccccacggggggaactttgcgccccttccctttggggggggggaattacaagaccccgccccactgacccctgcgctgggcggttcggcgggggaagggggttaaatctacctaaagggcgggaatccggttttcccaaaattggggggatcccccgaagaaaaacttgtgggccaagggcgctaaagggtccgaacccaaaaaggggcgcgtgggcggtttttccaagggtcccccctcttgaaggaccaaataattccccttagtcg

SEQ ID NO: 307587 - DNA, 960 bp, Homo sapiens
ctcccattacttcccgttttctcgatctgctgctcgtctcaggctcgtagttcgccttcaacatgccggaaccagcgaagtccgctcccgcgcccaagaagggctcgaagaaagccgtgactaaggcgcagaagaaggacggcaagaagcgcaagcgcagccgcaaggagagctactccgtatacgtgtacaaggtgctgaagcaggtccaccccgacaccggcatctcctctaaggccatgggaatcatgaactccttcgtcaacgacatcttcgaacgcatcgcgggtgaggcttcccgcctggcgcattacaacaagcgctcgaccatcacctccagggagatccagacggccgtgcgcctgctgctgcccggggagttggccaagcacgccgtgtccgagggcaccaaggccgtcaccaagtacaccagcgctaagtaaacttgccaaggagggactttctctggaatttcctgatatgaccaagaaagcttcttatcaaaagaagcacaattgccttcggttacctcattatctactgcagaaaagaagacgagaatgcaaccatacctagatggacttttccacaagctaaagctggcctcttgatctcattcagattccaaagagaatcatttacaagttaatttctgtctccttggtccattccttctctctaataatcatttactgttcctcaaagaattgtctacattacccatctcctcttttgcctctgagaaagagtatataagcttctgtaccccactggggggttggggtaatattctgtggtcctcagccctgtaccttaataaatttgtatgccttttctcttaaaaaaaacacacacaatactacacaccaaccccacaaaacaaaaaagcgggccaaaaccggggccaccacccttgaagggcccagaaaaaaaaaccgggcacaggggaacggtggacac

SEQ ID NO: 307588 - DNA, 567 bp, Homo sapiens
ggtatattgctaagttcttttctacttattttcatttctagtgtttggggtggagaattatccccccaaatatcgagcttggtaatggtgggtgtttttgaaaattgagggttctcagaaacaagtctaagaatcaaggtccctctaactttgtcctgtttctcttccccaaatacagggagggactttctctggaatttcctgatatgaccaagaaagcttcttatcaaaagaagcacaattgccttcggttacctcattatctactgcagaaaagaagacgagaatgcaaccatacctagatggacttttccacaagctaaagctggcctcttgatctcattcagattccaaagagaatcatttacaagttaatttctgtctccttggtccattccttctctctaataatcatttactgttcctcaaagaattgtctacattacccatctcctcttttgcctctgagaaagagtatataagcttctgtaccccactggggggttggggtaatattctgtggtcctcagccctgtaccttaataaatttgtatgccttttctctta

SEQ ID NO: 307589 - DNA, 944 bp, Homo sapiens
ggctgctcaagcccaacgcctcagtggccctccacaaacacagctgcattcatccgggtcgtgggctcggagtttgtacagaagtatctgggtgagggcccccgacccggatgaatgcagctgttgtgtctgctgctcgtctcaggctcgtagttcgccttcaacatgccggaaccagcgaagtccgctcccgcgcccaagaagggctcgaagaaagccgtgactaaggcgcagaagaaggacggcaagaagcgcaagcgcagccgcaaggagagctactccgtatacgtgtacaaggtgctgaagcaggtccaccccgacaccggcatctcctctaaggccatgggaatcatgaactccttcgtcaacgacatcttcgaacgcatcgcgggtgaggcttcccgcctggcgcattacaacaagcgctcgaccatcacctccagggagatccagacggccgtgcgcctgctgctgcccggggagttggccaagcacgccgtgtccgagggcaccaaggccgtcaccaagtacaccagcgctaagtaaacttgccaaggagggactttctctggaatttcctgatatgaccaagaaagcttcttatcaaaagaagcacaattgccttcggttacctcattatctactgcagaaaagaagacgagaatgcaaccatacctagatggacttttccacaagctaaagctggcctcttgatctcattcagattccaaagagaatcatttacaagttaatttctgtctccttggtccattccttctctctaataatcatttactgttcctcaaagaattgtctacattacccatctcctcttttgcctctgagaaagagtatataagcttctgtaccccactggggggttggggtaatattctgtggtcctcagccctgtaccttaataaatttgtatgccttttctctta

SEQ ID NO: 307590 - DNA, 494 bp, Homo sapiens
ctcccattacttcccgttttctcgatctgctgctcgtctcaggctcgtagttcgccttcaacatgccggaaccagcgaagtccgctcccgcgcccaagaagggctcgaagaaagccgtgactaaggcgcagaagaaggacggcaagaagcgcaagcgcagccgcaaggagagctactccgtatacgtgtacaaggtgctgaagcaggtccaccccgacaccggcatctcctctaaggccatgggaatcatgaactccttcgtcaacgacatcttcgaacgcatcgcgggtgaggcttcccgcctggcgcattacaacaagcgctcgaccatcacctccagggagatccagacggccgtgcgcctgctgctgcccggggagttggccaagcacgccgtgtccgagggcaccaaggccgtcaccaagtacaccagcgctaagtaaacttgccaagtaagcgtcttaaagcccaaccccaaaggctcttttaagagc

SEQ ID NO: 307591 - DNA, 682 bp, Homo sapiens
ctcccattacttcccgttttctcgatctgctgctcgtctcaggctcgtagttcgccttcaacatgccggaaccagcgaagtccgctcccgcgcccaagaagggctcgaagaaagccgtgactaaggcgcagaagaaggacggcaagaagcgcaagcgcagccgcaaggagagctactccgtatacgtgtacaaggtgctgaagcaggtccaccccgacaccggcatctcctctaaggccatgggaatcatgaactccttcgtcaacgacatcttcgaacgcatcgcgggtgaggcttcccgctggcctcttgatctcattcagattccaaagagaatcatttacaagttaatttctgtctccttggtccattccttctctctaataatcatttactgttcctcaaagaattgtctacattacccatctcctcttttgcctctgagaaagagtatataagcttctgtaccccactggggggttggggtaatattctgtggtcctcagccctgtaccttaataaatttgtatgccttttctcttaaaaaaaaatactatattgtcaatgggatagacttgtttcttgaagtaacttattataactgctggggggtcttgttgaattaatctcacattattctcatggggggggacctggttcactatatttcctaaaggggttg

SEQ ID NO: 307592 - DNA, 513 bp, Homo sapiens
gcccacaagagatggcgtccaaggagtagcatcgctccccagccatgcttccctgggatttgggcaagcctccctgcacaccaaacatgagcctcagggcgggctggaggagggggtttccggttcttctgcctctcctgggtctgacctcgtcgttgtcattgcccaggtggcatccaaggctctgctgtctgtccacagcatccggacctctcatctgtctacacccattgcttcaggcttggtccctccgccgtcagtaatgtccagcttcactcaggccgctcacctgcgctttacattccaacatctgctgtgagtgtgtcctctctgggcagccccccaccctccctcactccccaggggctcctcctctgaccctgtgcgcttcctccatgcttcccccacagttaggggcaccaccatccatccagtcacctgggaatgatcccagggtcaggtgatctgaggatggagaattgaccactgagcttggtggcgaggctggtgccc

SEQ ID NO: 307593 - DNA, 490 bp, Homo sapiens
cccgcaccgaaaccctaccctttccgcaatggcacatcagcagtaaaagtgttactcaatagcaggagcagaaaggccaaaatgatgagcgcaattgctgcgggtcccaggcccacataggagtcatgctgtgcttccctgcagccgctgccatagggtttgatgactcatcgaaaccctcatcaaaccctttcttcatgtgtcacccaaatagggcttgggtttttactttcacttcatttctgagattaaggtgtaaccaagtagagcatttctttgcttgatacagaaagttactagtctcaaccatggcctgggcataggagatgtcaaaataagtttatttcaaatggcaccatttaaatagggattcgatgacctcatcgaaaccctagtgacgaaaaataacaatacaggactctttcgaggccctgtaattggaatgaggccactttaaatcctttaacgaggatccattggaggggttaag

SEQ ID NO: 307594 - DNA, 6380 bp, Homo sapiens
  misc_feature (25)..(25): n is a, c, g, or t
agcgggtcttctcccggcctgagcngcagcagctgcggcggcggcggcgtttgagtggaggaagatggcggctccgggcggctcggggtcccgccagctgtgaggagccccgagcacggctgtcgcggcctgaggcagagcgcctctgctctggccctgtccctggctccctcattaccgtcgccagcggagcgaacccgagagcgtggagcgggctgggccagagatgggatttcgccatgttgcccacgctggtctcgaactcctgacctaaggtgatctgccggcctcagaatcccaaagtgctgggactacaggtgtgagccactgcacccaaccaagaactactatattttctgttgagtggaatgtcatggccagctcctcggacagtgaagatgacagtttcatggctgtggaccaggaagaaactgtgctggaagggacaatggatcaagatgaggagccccacccagtattggaggctgaggagactagacataataggtccatgtcggagctgccagaagaggttttggagtatatcctgtcctttctctcaccgtatcaggaacacaaaactgcggcccttgtctgcaaacagtggtatcgacttatcaaaggtgtagcccatcagtgttatcatggtttcatgaaggctgtccaggaaggaaacattcagtgggagagccgtacctatccttatcctggaaccccaatcactcagcgcttctcgcacagtgcatgctattatgatgctaatcagtctatgtatgtgtttggaggctgtacccagagcagctgcaatgctgctttcaatgacctctggagacttgacctaaacagcaaagagtggatccgacctttggcttcagggtcctatccttcccccaaagctggagcaactctggtcgtgtacaaggacttgctagtgctgtttggtggctggacgcggccaagcccttatcccctacaccagccagagagattctttgatgaaatacacacttactcaccctctaaaaattggtggaactgcattgtgacaacccatgggccacctcccatggctggccactcctcctgtgtgatagatgataaaatgattgtctttggtggctctttaggatcccggcaaatgagcaatgatgtctgggtccttgaccttgagcagtgggcgtggtccaagccgaacatctctggccccagtcctcatcctcgaggtggccaatctcagattgtcatagatgatgcaactatcttaatcctcggagggtgtggcggtcccaatgctctattcaaggatgcttggttgttgcacatgcattctggtccttgggcctggcagccactcaaggtagaaaatgaagagcatggggccccagaactgtggtgccatccagcttgccgggtgggacagtgtgtggtggtcttcagccaggctcctagtgggagagccccactcagccccagtttgaactctcgcccatcacctatcagtgccactcctccagctctcgttcctgaaacccgagagtaccgctctcagtctccagtaagaagcatggatgaagctccttgtgttaacggccgctggggaacactgagacccagggctcaaaggcagactccttcaggttcccgggaagggagcctttccccagccagaggagacggctctcctatcctcaatggtgggagtttgtctccaggaacggcagctgtgggtggctcttctttggacagtcctgtacaggccatatctccaagtactccatctgctcctgaaggatacgacctgaaaataggactttctttggccccccgacgaggatcactaccagatcagaaagatctgagattaggatccatagatctgaattgggatctgaaacccgcttccagtagtaatcccatggatggcatggacaataggacagttgggggaagtatgagacaccctcctgaacagacaaatggtgtgcataccccacctcacgtggccagtgcccttgcaggggccgtctccccaggtgccctgcgtcggagtctggaagccatcaaagcgatgtcctccaaaggcccctcggcctctgcagcactaagtcctcctcttgggtcttctccaggctctcctgggagccagagtttgagcagtggagaaacagtgcccatccctcgcccagggcctgcccaaggagatggacattccttacctcccattgctcgccgcctgggccaccaccctccacagtccctaaatgttggcaaacccctataccagagtatgaactgcaagcccatgcagatgtacgtgctggacattaaagacaccaaggagaaggggcgggtcaaatggaaagtatttaatagcagttctgtggttggacctcctgaaaccagcctgcataccgtggtacaaggcaggggtgaactcatcatatttggaggactcatggacaagaaacagaatgtgaagtactatccaaaaacaaacgccttgtactttgtacgagcaaagagataatgtgttctaaacccctttccttttctgtggcttttaatttggaattttccagtgtgtaagcatttggactgagaattgggaaaacaaaattactcccagaagccaaaactctttaattcccaaccgaagtcactccaggctgggatcaaatctccattaagaaaaaaaattatatataaatatatatatatatattatatagccaactctgttgacaaaaaaagggagagatttccatcctggttcagataaagttgttgctgtgttttaacaggggctgggctgcctttttctaccttgctggtaactagaccaagaagttagagaatagactaacatcagtaacttcccaaaagaaactgaagagccccctgtaaatctttatgtggccttcttggagttaaaaaatgaaagggcatatgtaagttgcaaaggtggagggttttagactctcatgcttcaggtgctgtcggggtaaaagtaactgtttttccccttctcttaaaaccacagaggacctgtgacagctctgcagaaatgccagtgcctggccccctcttgccttttatggctgaggaaagttacccaacaaaggattttattccacatttgtgtgccgggtcattgtgaaataatgtttatgcagccaacatctgaccgcctagtagtgtccattggtctttggagtgcttcttgtgtgtctcagaaaacattttgtgtctgattgtggaaatttctgacaatcaatcatatttggtggcaagttgccaaaaaacatatttattctcctctttcttcccttagaacatggtacttggaaactgccttttccattcacttacaggctgcttttttcttctaccttttttcttttcttttttttttttcatatgtggtgaagtcctaaaacctgtctgactttctgtttcttttacaaagctcaggtgcctacagaaatcagaagctgcttagaaatacttgtggaaccctttccctggtgtcactagggggccagtagggaattctaagatgccaatattgtgagaaatctttgaagcaagcatcaaaagatactgttttttccctatgggcttctttttacttccaaagcacattgagcacactcatcccatatttgtagaatgtggaaattgattctggaagggaattccaataacagttctttttagaaatgtttttttccttgtggtgacatatattcctcttcctggctattggcaggtgatggagttgagaatcatgtacttgacttcttgacgcatggctgacctcagaaacagctccatcctttgcacttgtcttcttcatgtgtcacccaaatagggcttgggtttttactttcacttcatttctgagattaaggtgtaaccaagtagagcatttctttgcttgatacagaaagttactagtctcaaccatggcctgggcataggagatgtcaaaataagtttatttcaaatggcaccatttaaatagggatttttggtgatttctcatcagtggaaagaggatttttgttttgcctttgttttgttttgaaatttaaatcctaatttcaaaacatcaccttgccaccctgacactcctctttttattattagcgtttctcaggcacaaagcctgctgcagctggccctgggtcctggctttcagccagcatctggcagcctaagtgtactgataagtgtgttttctcctgttacatcatgctgaatcctttcccttagccattagcttttatgatgtggtcttcgtaggaaagccaccctggtgccaagcctagcttgtggggaggggtatgtgttccagaaactgctctttgtgttcccttcaatgaggaaacaacatgtgtctacttatgtggcatccaactgcttggagctccacacttccctttcgcgactcaggctctggtgctgttgccaatccttgcttggcaaagactgttcgatcatgtggggtccttatttacaagggaaagctgggccagaaggctagcaattcaggtgttaccgctattgctgtaccttgtgttaggacattgtgtttgtgcatggactgtgcctccaaactcagtagttcctatctaaatataaagtatattagaaacctgaaagtacagaatctcaaccttacagtctttcccttagtcctgtggccttcctaagccagctgttaacgtgttgattccttccacttcccccaagtaggcaggcaacagatatgttgattgtcttagaaagtaatctggttcctctgaactccattgaattccagtttgacgcatactgcctggaaccagactgtttgcttacagctttttaagaaaaatctgccttgtctgcccccattatggttggtcttggtagctcctgggcactgtgggcgtgtaccatgggaaagtgattcaacacagtgaaggtgattgtctcctcaggcctcctgaagccacctgtgcggtgggacttcacgtgtctcggccaaggcgagcatttccacaatgccgtggatgctgcagtcaggccagattgaaccatgaccccatttttcacatgataccaattttgtcttaaaattcactgagaaaaatgagactaaattttttttaaccctcaggagcacctgaagcaaatatttatccgtatttattgaaaattcattttgtttctacttgaagctttaaccccttccattcctgcaagtgtgccttttgagagctcccatggcctagtgacttcactggtcaccttgtccatcttacttaagaattttagtctctccctaccctcttggacagagcttcctgttctcttatttcacaggttatgcagcagagcgggttttgtgttttcattcctatttccacccttcatttggttggtggactccacaacctcaccctaccctacactttgggagcacaaatttggtgttgaaacaagcttaaatttcattttagggcatactgggcttactctcctcccagctgtctgtggattgatttgattttaatgttcgagttttacagcaacagctgaaaaccatgaactattctaggaactgtgttggaactctttaaaataaagaaaagaggaggaggaggaggaagaaagaaaaccaacttaagaagccttgactttggaggacagaaagccaccagccaatggagaacaaagagatgtttccctttcctttctttcaccttgtcattctgggtttccttctgcttcactctttccttcccccttaaaagtggtattcctggttggtctgtctgtctgtccttgtccttgtggtgatcctggcatggtgatatgctccactttgcattatccatggtctcttaccagcgcacaagtcagtggggaggatctaaccacgcctggtggtgaggaagctgaatttccaggcctgcgtcccatgtagcctctccatgaactgcagaaggcatgttctgcatggttaccagtaagtggctccctctcaccgtgttcattgtcaaatgagagcaaactttaggtgttggctccattgtacactctacttgctctgctcccctccctccaaccagggttcatgtcagtgcacaccccatgtgccctggcgaagctggtgctgtgagtgatgtttcccatacaactcagggatgccaggtggcttaccctgagatagtcattttgggcacataacagtgtaggaatgaaacatggatttcattgatatttaaatctgtcaatttcattttttgttaatgttttcccctgatgactttttagcaatttaacaaataaaatggacaattgtcttaactgttttattagcaaaaaaagaa

SEQ ID NO: 307595 - DNA, 6248 bp, Homo sapiens
  misc_feature (25)..(25): n is a, c, g, or t
agcgggtcttctcccggcctgagcngcagcagctgcggcggcggcggcgtttgagtggaggaagatggcggctccgggcggctcggggtcccgccagctgtgaggagccccgagcacggctgtcgcggcctgaggcagagcgcctctgctctggccctgtccctggctccctcattaccgtcgccagcggagcgaacccgagagcgtggagcgggctgggccagctgttgagtggaatgtcatggccagctcctcggacagtgaagatgacagtttcatggctgtggaccaggaagaaactgtgctggaagggacaatggatcaagatgaggagccccacccagtattggaggctgaggagactagacataataggtccatgtcggagctgccagaagaggttttggagtatatcctgtcctttctctcaccgtatcaggaacacaaaactgcggcccttgtctgcaaacagtggtatcgacttatcaaaggtgtagcccatcagtgttatcatggtttcatgaaggctgtccaggaaggaaacattcagtgggagagccgtacctatccttatcctggaaccccaatcactcagcgcttctcgcacagtgcatgctattatgatgctaatcagtctatgtatgtgtttggaggctgtacccagagcagctgcaatgctgctttcaatgacctctggagacttgacctaaacagcaaagagtggatccgacctttggcttcagggtcctatccttcccccaaagctggagcaactctggtcgtgtacaaggacttgctagtgctgtttggtggctggacgcggccaagcccttatcccctacaccagccagagagattctttgatgaaatacacacttactcaccctctaaaaattggtggaactgcattgtgacaacccatgggccacctcccatggctggccactcctcctgtgtgatagatgataaaatgattgtctttggtggctctttaggatcccggcaaatgagcaatgatgtctgggtccttgaccttgagcagtgggcgtggtccaagccgaacatctctggccccagtcctcatcctcgaggtggccaatctcagattgtcatagatgatgcaactatcttaatcctcggagggtgtggcggtcccaatgctctattcaaggatgcttggttgttgcacatgcattctggtccttgggcctggcagccactcaaggtagaaaatgaagagcatggggccccagaactgtggtgccatccagcttgccgggtgggacagtgtgtggtggtcttcagccaggctcctagtgggagagccccactcagccccagtttgaactctcgcccatcacctatcagtgccactcctccagctctcgttcctgaaacccgagagtaccgctctcagtctccagtaagaagcatggatgaagctccttgtgttaacggccgctggggaacactgagacccagggctcaaaggcagactccttcaggttcccgggaagggagcctttccccagccagaggagacggctctcctatcctcaatggtgggagtttgtctccaggaacggcagctgtgggtggctcttctttggacagtcctgtacaggccatatctccaagtactccatctgctcctgaaggatacgacctgaaaataggactttctttggccccccgacgaggatcactaccagatcagaaagatctgagattaggatccatagatctgaattgggatctgaaacccgcttccagtagtaatcccatggatggcatggacaataggacagttgggggaagtatgagacaccctcctgaacagacaaatggtgtgcataccccacctcacgtggccagtgcccttgcaggggccgtctccccaggtgccctgcgtcggagtctggaagccatcaaagcgatgtcctccaaaggcccctcggcctctgcagcactaagtcctcctcttgggtcttctccaggctctcctgggagccagagtttgagcagtggagaaacagtgcccatccctcgcccagggcctgcccaaggagatggacattccttacctcccattgctcgccgcctgggccaccaccctccacagtccctaaatgttggcaaacccctataccagagtatgaactgcaagcccatgcagatgtacgtgctggacattaaagacaccaaggagaaggggcgggtcaaatggaaagtatttaatagcagttctgtggttggacctcctgaaaccagcctgcataccgtggtacaaggcaggggtgaactcatcatatttggaggactcatggacaagaaacagaatgtgaagtactatccaaaaacaaacgccttgtactttgtacgagcaaagagataatgtgttctaaacccctttccttttctgtggcttttaatttggaattttccagtgtgtaagcatttggactgagaattgggaaaacaaaattactcccagaagccaaaactctttaattcccaaccgaagtcactccaggctgggatcaaatctccattaagaaaaaaaattatatataaatatatatatatatattatatagccaactctgttgacaaaaaaagggagagatttccatcctggttcagataaagttgttgctgtgttttaacaggggctgggctgcctttttctaccttgctggtaactagaccaagaagttagagaatagactaacatcagtaacttcccaaaagaaactgaagagccccctgtaaatctttatgtggccttcttggagttaaaaaatgaaagggcatatgtaagttgcaaaggtggagggttttagactctcatgcttcaggtgctgtcggggtaaaagtaactgtttttccccttctcttaaaaccacagaggacctgtgacagctctgcagaaatgccagtgcctggccccctcttgccttttatggctgaggaaagttacccaacaaaggattttattccacatttgtgtgccgggtcattgtgaaataatgtttatgcagccaacatctgaccgcctagtagtgtccattggtctttggagtgcttcttgtgtgtctcagaaaacattttgtgtctgattgtggaaatttctgacaatcaatcatatttggtggcaagttgccaaaaaacatatttattctcctctttcttcccttagaacatggtacttggaaactgccttttccattcacttacaggctgcttttttcttctaccttttttcttttcttttttttttttcatatgtggtgaagtcctaaaacctgtctgactttctgtttcttttacaaagctcaggtgcctacagaaatcagaagctgcttagaaatacttgtggaaccctttccctggtgtcactagggggccagtagggaattctaagatgccaatattgtgagaaatctttgaagcaagcatcaaaagatactgttttttccctatgggcttctttttacttccaaagcacattgagcacactcatcccatatttgtagaatgtggaaattgattctggaagggaattccaataacagttctttttagaaatgtttttttccttgtggtgacatatattcctcttcctggctattggcaggtgatggagttgagaatcatgtacttgacttcttgacgcatggctgacctcagaaacagctccatcctttgcacttgtcttcttcatgtgtcacccaaatagggcttgggtttttactttcacttcatttctgagattaaggtgtaaccaagtagagcatttctttgcttgatacagaaagttactagtctcaaccatggcctgggcataggagatgtcaaaataagtttatttcaaatggcaccatttaaatagggatttttggtgatttctcatcagtggaaagaggatttttgttttgcctttgttttgttttgaaatttaaatcctaatttcaaaacatcaccttgccaccctgacactcctctttttattattagcgtttctcaggcacaaagcctgctgcagctggccctgggtcctggctttcagccagcatctggcagcctaagtgtactgataagtgtgttttctcctgttacatcatgctgaatcctttcccttagccattagcttttatgatgtggtcttcgtaggaaagccaccctggtgccaagcctagcttgtggggaggggtatgtgttccagaaactgctctttgtgttcccttcaatgaggaaacaacatgtgtctacttatgtggcatccaactgcttggagctccacacttccctttcgcgactcaggctctggtgctgttgccaatccttgcttggcaaagactgttcgatcatgtggggtccttatttacaagggaaagctgggccagaaggctagcaattcaggtgttaccgctattgctgtaccttgtgttaggacattgtgtttgtgcatggactgtgcctccaaactcagtagttcctatctaaatataaagtatattagaaacctgaaagtacagaatctcaaccttacagtctttcccttagtcctgtggccttcctaagccagctgttaacgtgttgattccttccacttcccccaagtaggcaggcaacagatatgttgattgtcttagaaagtaatctggttcctctgaactccattgaattccagtttgacgcatactgcctggaaccagactgtttgcttacagctttttaagaaaaatctgccttgtctgcccccattatggttggtcttggtagctcctgggcactgtgggcgtgtaccatgggaaagtgattcaacacagtgaaggtgattgtctcctcaggcctcctgaagccacctgtgcggtgggacttcacgtgtctcggccaaggcgagcatttccacaatgccgtggatgctgcagtcaggccagattgaaccatgaccccatttttcacatgataccaattttgtcttaaaattcactgagaaaaatgagactaaattttttttaaccctcaggagcacctgaagcaaatatttatccgtatttattgaaaattcattttgtttctacttgaagctttaaccccttccattcctgcaagtgtgccttttgagagctcccatggcctagtgacttcactggtcaccttgtccatcttacttaagaattttagtctctccctaccctcttggacagagcttcctgttctcttatttcacaggttatgcagcagagcgggttttgtgttttcattcctatttccacccttcatttggttggtggactccacaacctcaccctaccctacactttgggagcacaaatttggtgttgaaacaagcttaaatttcattttagggcatactgggcttactctcctcccagctgtctgtggattgatttgattttaatgttcgagttttacagcaacagctgaaaaccatgaactattctaggaactgtgttggaactctttaaaataaagaaaagaggaggaggaggaggaagaaagaaaaccaacttaagaagccttgactttggaggacagaaagccaccagccaatggagaacaaagagatgtttccctttcctttctttcaccttgtcattctgggtttccttctgcttcactctttccttcccccttaaaagtggtattcctggttggtctgtctgtctgtccttgtccttgtggtgatcctggcatggtgatatgctccactttgcattatccatggtctcttaccagcgcacaagtcagtggggaggatctaaccacgcctggtggtgaggaagctgaatttccaggcctgcgtcccatgtagcctctccatgaactgcagaaggcatgttctgcatggttaccagtaagtggctccctctcaccgtgttcattgtcaaatgagagcaaactttaggtgttggctccattgtacactctacttgctctgctcccctccctccaaccagggttcatgtcagtgcacaccccatgtgccctggcgaagctggtgctgtgagtgatgtttcccatacaactcagggatgccaggtggcttaccctgagatagtcattttgggcacataacagtgtaggaatgaaacatggatttcattgatatttaaatctgtcaatttcattttttgttaatgttttcccctgatgactttttagcaatttaacaaataaaatggacaattgtcttaactgttttattagcaaaaaaagaa

SEQ ID NO: 307596 - DNA, 6075 bp, Homo sapiens
tctggagacttgacctaaacagcaaagagtggatccgacctttggcttcagctgttgagtggaatgtcatggccagctcctcggacagtgaagatgacagtttcatggctgtggaccaggaagaaactgtgctggaagggacaatggatcaagatgaggagccccacccagtattggaggctgaggagactagacataataggtccatgtcggagctgccagaagaggttttggagtatatcctgtcctttctctcaccgtatcaggaacacaaaactgcggcccttgtctgcaaacagtggtatcgacttatcaaaggtgtagcccatcagtgttatcatggtttcatgaaggctgtccaggaaggaaacattcagtgggagagccgtacctatccttatcctggaaccccaatcactcagcgcttctcgcacagtgcatgctattatgatgctaatcagtctatgtatgtgtttggaggctgtacccagagcagctgcaatgctgctttcaatgacctctggagacttgacctaaacagcaaagagtggatccgacctttggcttcagggtcctatccttcccccaaagctggagcaactctggtcgtgtacaaggacttgctagtgctgtttggtggctggacgcggccaagcccttatcccctacaccagccagagagattctttgatgaaatacacacttactcaccctctaaaaattggtggaactgcattgtgacaacccatgggccacctcccatggctggccactcctcctgtgtgatagatgataaaatgattgtctttggtggctctttaggatcccggcaaatgagcaatgatgtctgggtccttgaccttgagcagtgggcgtggtccaagccgaacatctctggccccagtcctcatcctcgaggtggccaatctcagattgtcatagatgatgcaactatcttaatcctcggagggtgtggcggtcccaatgctctattcaaggatgcttggttgttgcacatgcattctggtccttgggcctggcagccactcaaggtagaaaatgaagagcatggggccccagaactgtggtgccatccagcttgccgggtgggacagtgtgtggtggtcttcagccaggctcctagtgggagagccccactcagccccagtttgaactctcgcccatcacctatcagtgccactcctccagctctcgttcctgaaacccgagagtaccgctctcagtctccagtaagaagcatggatgaagctccttgtgttaacggccgctggggaacactgagacccagggctcaaaggcagactccttcaggttcccgggaagggagcctttccccagccagaggagacggctctcctatcctcaatggtgggagtttgtctccaggaacggcagctgtgggtggctcttctttggacagtcctgtacaggccatatctccaagtactccatctgctcctgaaggatacgacctgaaaataggactttctttggccccccgacgaggatcactaccagatcagaaagatctgagattaggatccatagatctgaattgggatctgaaacccgcttccagtagtaatcccatggatggcatggacaataggacagttgggggaagtatgagacaccctcctgaacagacaaatggtgtgcataccccacctcacgtggccagtgcccttgcaggggccgtctccccaggtgccctgcgtcggagtctggaagccatcaaagcgatgtcctccaaaggcccctcggcctctgcagcactaagtcctcctcttgggtcttctccaggctctcctgggagccagagtttgagcagtggagaaacagtgcccatccctcgcccagggcctgcccaaggagatggacattccttacctcccattgctcgccgcctgggccaccaccctccacagtccctaaatgttggcaaacccctataccagagtatgaactgcaagcccatgcagatgtacgtgctggacattaaagacaccaaggagaaggggcgggtcaaatggaaagtatttaatagcagttctgtggttggacctcctgaaaccagcctgcataccgtggtacaaggcaggggtgaactcatcatatttggaggactcatggacaagaaacagaatgtgaagtactatccaaaaacaaacgccttgtactttgtacgagcaaagagataatgtgttctaaacccctttccttttctgtggcttttaatttggaattttccagtgtgtaagcatttggactgagaattgggaaaacaaaattactcccagaagccaaaactctttaattcccaaccgaagtcactccaggctgggatcaaatctccattaagaaaaaaaattatatataaatatatatatatatattatatagccaactctgttgacaaaaaaagggagagatttccatcctggttcagataaagttgttgctgtgttttaacaggggctgggctgcctttttctaccttgctggtaactagaccaagaagttagagaatagactaacatcagtaacttcccaaaagaaactgaagagccccctgtaaatctttatgtggccttcttggagttaaaaaatgaaagggcatatgtaagttgcaaaggtggagggttttagactctcatgcttcaggtgctgtcggggtaaaagtaactgtttttccccttctcttaaaaccacagaggacctgtgacagctctgcagaaatgccagtgcctggccccctcttgccttttatggctgaggaaagttacccaacaaaggattttattccacatttgtgtgccgggtcattgtgaaataatgtttatgcagccaacatctgaccgcctagtagtgtccattggtctttggagtgcttcttgtgtgtctcagaaaacattttgtgtctgattgtggaaatttctgacaatcaatcatatttggtggcaagttgccaaaaaacatatttattctcctctttcttcccttagaacatggtacttggaaactgccttttccattcacttacaggctgcttttttcttctaccttttttcttttcttttttttttttcatatgtggtgaagtcctaaaacctgtctgactttctgtttcttttacaaagctcaggtgcctacagaaatcagaagctgcttagaaatacttgtggaaccctttccctggtgtcactagggggccagtagggaattctaagatgccaatattgtgagaaatctttgaagcaagcatcaaaagatactgttttttccctatgggcttctttttacttccaaagcacattgagcacactcatcccatatttgtagaatgtggaaattgattctggaagggaattccaataacagttctttttagaaatgtttttttccttgtggtgacatatattcctcttcctggctattggcaggtgatggagttgagaatcatgtacttgacttcttgacgcatggctgacctcagaaacagctccatcctttgcacttgtcttcttcatgtgtcacccaaatagggcttgggtttttactttcacttcatttctgagattaaggtgtaaccaagtagagcatttctttgcttgatacagaaagttactagtctcaaccatggcctgggcataggagatgtcaaaataagtttatttcaaatggcaccatttaaatagggatttttggtgatttctcatcagtggaaagaggatttttgttttgcctttgttttgttttgaaatttaaatcctaatttcaaaacatcaccttgccaccctgacactcctctttttattattagcgtttctcaggcacaaagcctgctgcagctggccctgggtcctggctttcagccagcatctggcagcctaagtgtactgataagtgtgttttctcctgttacatcatgctgaatcctttcccttagccattagcttttatgatgtggtcttcgtaggaaagccaccctggtgccaagcctagcttgtggggaggggtatgtgttccagaaactgctctttgtgttcccttcaatgaggaaacaacatgtgtctacttatgtggcatccaactgcttggagctccacacttccctttcgcgactcaggctctggtgctgttgccaatccttgcttggcaaagactgttcgatcatgtggggtccttatttacaagggaaagctgggccagaaggctagcaattcaggtgttaccgctattgctgtaccttgtgttaggacattgtgtttgtgcatggactgtgcctccaaactcagtagttcctatctaaatataaagtatattagaaacctgaaagtacagaatctcaaccttacagtctttcccttagtcctgtggccttcctaagccagctgttaacgtgttgattccttccacttcccccaagtaggcaggcaacagatatgttgattgtcttagaaagtaatctggttcctctgaactccattgaattccagtttgacgcatactgcctggaaccagactgtttgcttacagctttttaagaaaaatctgccttgtctgcccccattatggttggtcttggtagctcctgggcactgtgggcgtgtaccatgggaaagtgattcaacacagtgaaggtgattgtctcctcaggcctcctgaagccacctgtgcggtgggacttcacgtgtctcggccaaggcgagcatttccacaatgccgtggatgctgcagtcaggccagattgaaccatgaccccatttttcacatgataccaattttgtcttaaaattcactgagaaaaatgagactaaattttttttaaccctcaggagcacctgaagcaaatatttatccgtatttattgaaaattcattttgtttctacttgaagctttaaccccttccattcctgcaagtgtgccttttgagagctcccatggcctagtgacttcactggtcaccttgtccatcttacttaagaattttagtctctccctaccctcttggacagagcttcctgttctcttatttcacaggttatgcagcagagcgggttttgtgttttcattcctatttccacccttcatttggttggtggactccacaacctcaccctaccctacactttgggagcacaaatttggtgttgaaacaagcttaaatttcattttagggcatactgggcttactctcctcccagctgtctgtggattgatttgattttaatgttcgagttttacagcaacagctgaaaaccatgaactattctaggaactgtgttggaactctttaaaataaagaaaagaggaggaggaggaggaagaaagaaaaccaacttaagaagccttgactttggaggacagaaagccaccagccaatggagaacaaagagatgtttccctttcctttctttcaccttgtcattctgggtttccttctgcttcactctttccttcccccttaaaagtggtattcctggttggtctgtctgtctgtccttgtccttgtggtgatcctggcatggtgatatgctccactttgcattatccatggtctcttaccagcgcacaagtcagtggggaggatctaaccacgcctggtggtgaggaagctgaatttccaggcctgcgtcccatgtagcctctccatgaactgcagaaggcatgttctgcatggttaccagtaagtggctccctctcaccgtgttcattgtcaaatgagagcaaactttaggtgttggctccattgtacactctacttgctctgctcccctccctccaaccagggttcatgtcagtgcacaccccatgtgccctggcgaagctggtgctgtgagtgatgtttcccatacaactcagggatgccaggtggcttaccctgagatagtcattttgggcacataacagtgtaggaatgaaacatggatttcattgatatttaaatctgtcaatttcattttttgttaatgttttcccctgatgactttttagcaatttaacaaataaaatggacaattgtcttaactgttttattagcaaaaaaagaa

SEQ ID NO: 307597 - DNA, 6407 bp, Homo sapiens
tcataaggctaaattatcgccaacacctttgctttggagtaaataatatcaatgatcttgatatgttgccttatgagataaaataaaagggactagagttacagtgtgagctaattttgtaatctttaatgtcacctaacctccatgaactttgataaaatggaaggattgcctttcagttttaaaattgtatttcctttctttgaatgaaaatcagataaatttggaattcctcaaagaaacttgtcttataggctgggcgcggtggctcatgcctgtaatctcagcactttggaaggccgaggcaggtggatcacgaggtcaggagttcaagaccagcctggccaagatggtgaaaccccatctctactaaaaataaaattagctgggcatggtggcaggtacctgtaatcccagctactcgggaggctgaagcaggagaatcacttgaacccaggaggcagaggttgcagtggccgagatcgtgccactgcactccaacctgggcgacagagtgagactccatctcaaaaaaagaaaaagaaaagaaacttgtataaaaatgataaaaacaggtaatagacacagttttaataatttgatggataagttaagtgtctggactgaagggtttgctctttctgtcttaggtgtagcccatcagtgttatcatggtttcatgaaggctgtccaggaaggaaacattcagtgggagagccgtacctatccttatcctggaaccccaatcactcagcgcttctcgcacagtgcatgctattatgatgctaatcagtctatgtatgtgtttggaggctgtacccagagcagctgcaatgctgctttcaatgacctctggagacttgacctaaacagcaaagagtggatccgacctttggcttcagggtcctatccttcccccaaagctggagcaactctggtcgtgtacaaggacttgctagtgctgtttggtggctggacgcggccaagcccttatcccctacaccagccagagagattctttgatgaaatacacacttactcaccctctaaaaattggtggaactgcattgtgacaacccatgggccacctcccatggctggccactcctcctgtgtgatagatgataaaatgattgtctttggtggctctttaggatcccggcaaatgagcaatgatgtctgggtccttgaccttgagcagtgggcgtggtccaagccgaacatctctggccccagtcctcatcctcgaggtggccaatctcagattgtcatagatgatgcaactatcttaatcctcggagggtgtggcggtcccaatgctctattcaaggatgcttggttgttgcacatgcattctggtccttgggcctggcagccactcaaggtagaaaatgaagagcatggggccccagaactgtggtgccatccagcttgccgggtgggacagtgtgtggtggtcttcagccaggctcctagtgggagagccccactcagccccagtttgaactctcgcccatcacctatcagtgccactcctccagctctcgttcctgaaacccgagagtaccgctctcagtctccagtaagaagcatggatgaagctccttgtgttaacggccgctggggaacactgagacccagggctcaaaggcagactccttcaggttcccgggaagggagcctttccccagccagaggagacggctctcctatcctcaatggtgggagtttgtctccaggaacggcagctgtgggtggctcttctttggacagtcctgtacaggccatatctccaagtactccatctgctcctgaaggatacgacctgaaaataggactttctttggccccccgacgaggatcactaccagatcagaaagatctgagattaggatccatagatctgaattgggatctgaaacccgcttccagtagtaatcccatggatggcatggacaataggacagttgggggaagtatgagacaccctcctgaacagacaaatggtgtgcataccccacctcacgtggccagtgcccttgcaggggccgtctccccaggtgccctgcgtcggagtctggaagccatcaaagcgatgtcctccaaaggcccctcggcctctgcagcactaagtcctcctcttgggtcttctccaggctctcctgggagccagagtttgagcagtggagaaacagtgcccatccctcgcccagggcctgcccaaggagatggacattccttacctcccattgctcgccgcctgggccaccaccctccacagtccctaaatgttggcaaacccctataccagagtatgaactgcaagcccatgcagatgtacgtgctggacattaaagacaccaaggagaaggggcgggtcaaatggaaagtatttaatagcagttctgtggttggacctcctgaaaccagcctgcataccgtggtacaaggcaggggtgaactcatcatatttggaggactcatggacaagaaacagaatgtgaagtactatccaaaaacaaacgccttgtactttgtacgagcaaagagataatgtgttctaaacccctttccttttctgtggcttttaatttggaattttccagtgtgtaagcatttggactgagaattgggaaaacaaaattactcccagaagccaaaactctttaattcccaaccgaagtcactccaggctgggatcaaatctccattaagaaaaaaaattatatataaatatatatatatatattatatagccaactctgttgacaaaaaaagggagagatttccatcctggttcagataaagttgttgctgtgttttaacaggggctgggctgcctttttctaccttgctggtaactagaccaagaagttagagaatagactaacatcagtaacttcccaaaagaaactgaagagccccctgtaaatctttatgtggccttcttggagttaaaaaatgaaagggcatatgtaagttgcaaaggtggagggttttagactctcatgcttcaggtgctgtcggggtaaaagtaactgtttttccccttctcttaaaaccacagaggacctgtgacagctctgcagaaatgccagtgcctggccccctcttgccttttatggctgaggaaagttacccaacaaaggattttattccacatttgtgtgccgggtcattgtgaaataatgtttatgcagccaacatctgaccgcctagtagtgtccattggtctttggagtgcttcttgtgtgtctcagaaaacattttgtgtctgattgtggaaatttctgacaatcaatcatatttggtggcaagttgccaaaaaacatatttattctcctctttcttcccttagaacatggtacttggaaactgccttttccattcacttacaggctgcttttttcttctaccttttttcttttcttttttttttttcatatgtggtgaagtcctaaaacctgtctgactttctgtttcttttacaaagctcaggtgcctacagaaatcagaagctgcttagaaatacttgtggaaccctttccctggtgtcactagggggccagtagggaattctaagatgccaatattgtgagaaatctttgaagcaagcatcaaaagatactgttttttccctatgggcttctttttacttccaaagcacattgagcacactcatcccatatttgtagaatgtggaaattgattctggaagggaattccaataacagttctttttagaaatgtttttttccttgtggtgacatatattcctcttcctggctattggcaggtgatggagttgagaatcatgtacttgacttcttgacgcatggctgacctcagaaacagctccatcctttgcacttgtcttcttcatgtgtcacccaaatagggcttgggtttttactttcacttcatttctgagattaaggtgtaaccaagtagagcatttctttgcttgatacagaaagttactagtctcaaccatggcctgggcataggagatgtcaaaataagtttatttcaaatggcaccatttaaatagggatttttggtgatttctcatcagtggaaagaggatttttgttttgcctttgttttgttttgaaatttaaatcctaatttcaaaacatcaccttgccaccctgacactcctctttttattattagcgtttctcaggcacaaagcctgctgcagctggccctgggtcctggctttcagccagcatctggcagcctaagtgtactgataagtgtgttttctcctgttacatcatgctgaatcctttcccttagccattagcttttatgatgtggtcttcgtaggaaagccaccctggtgccaagcctagcttgtggggaggggtatgtgttccagaaactgctctttgtgttcccttcaatgaggaaacaacatgtgtctacttatgtggcatccaactgcttggagctccacacttccctttcgcgactcaggctctggtgctgttgccaatccttgcttggcaaagactgttcgatcatgtggggtccttatttacaagggaaagctgggccagaaggctagcaattcaggtgttaccgctattgctgtaccttgtgttaggacattgtgtttgtgcatggactgtgcctccaaactcagtagttcctatctaaatataaagtatattagaaacctgaaagtacagaatctcaaccttacagtctttcccttagtcctgtggccttcctaagccagctgttaacgtgttgattccttccacttcccccaagtaggcaggcaacagatatgttgattgtcttagaaagtaatctggttcctctgaactccattgaattccagtttgacgcatactgcctggaaccagactgtttgcttacagctttttaagaaaaatctgccttgtctgcccccattatggttggtcttggtagctcctgggcactgtgggcgtgtaccatgggaaagtgattcaacacagtgaaggtgattgtctcctcaggcctcctgaagccacctgtgcggtgggacttcacgtgtctcggccaaggcgagcatttccacaatgccgtggatgctgcagtcaggccagattgaaccatgaccccatttttcacatgataccaattttgtcttaaaattcactgagaaaaatgagactaaattttttttaaccctcaggagcacctgaagcaaatatttatccgtatttattgaaaattcattttgtttctacttgaagctttaaccccttccattcctgcaagtgtgccttttgagagctcccatggcctagtgacttcactggtcaccttgtccatcttacttaagaattttagtctctccctaccctcttggacagagcttcctgttctcttatttcacaggttatgcagcagagcgggttttgtgttttcattcctatttccacccttcatttggttggtggactccacaacctcaccctaccctacactttgggagcacaaatttggtgttgaaacaagcttaaatttcattttagggcatactgggcttactctcctcccagctgtctgtggattgatttgattttaatgttcgagttttacagcaacagctgaaaaccatgaactattctaggaactgtgttggaactctttaaaataaagaaaagaggaggaggaggaggaagaaagaaaaccaacttaagaagccttgactttggaggacagaaagccaccagccaatggagaacaaagagatgtttccctttcctttctttcaccttgtcattctgggtttccttctgcttcactctttccttcccccttaaaagtggtattcctggttggtctgtctgtctgtccttgtccttgtggtgatcctggcatggtgatatgctccactttgcattatccatggtctcttaccagcgcacaagtcagtggggaggatctaaccacgcctggtggtgaggaagctgaatttccaggcctgcgtcccatgtagcctctccatgaactgcagaaggcatgttctgcatggttaccagtaagtggctccctctcaccgtgttcattgtcaaatgagagcaaactttaggtgttggctccattgtacactctacttgctctgctcccctccctccaaccagggttcatgtcagtgcacaccccatgtgccctggcgaagctggtgctgtgagtgatgtttcccatacaactcagggatgccaggtggcttaccctgagatagtcattttgggcacataacagtgtaggaatgaaacatggatttcattgatatttaaatctgtcaatttcattttttgttaatgttttcccctgatgactttttagcaatttaacaaataaaatggacaattgtcttaactgttttattagcaaaaaaagaa

SEQ ID NO: 307598 - DNA, 6303 bp, Homo sapiens
ctggctaatttttgtattttagtagagatgggatttcgccatgttgcccacgctggtctcgaactcctgacctaaggtgatctgccggcctcagaatcccaaagtgctgggactacaggtgtgagccactgcacccaaccaagaactactatattttctgttgagtggaatgtcatggccagctcctcggacagtgaagatgacagtttcatggctgtggaccaggaagaaactgtgctggaagggacaatggatcaagatgaggagccccacccagtattggaggctgaggagactagacataataggtccatgtcggagctgccagaagaggttttggagtatatcctgtcctttctctcaccgtatcaggaacacaaaactgcggcccttgtctgcaaacagtggtatcgacttatcaaagatggaacctcactccatcacccaggctggagttcagtggcgcagtctcagctcattgcaacctccacctcctgggttcaaggaattctcctgcttccacctcccaagtagctgggattacaggtgtagcccatcagtgttatcatggtttcatgaaggctgtccaggaaggaaacattcagtgggagagccgtacctatccttatcctggaaccccaatcactcagcgcttctcgcacagtgcatgctattatgatgctaatcagtctatgtatgtgtttggaggctgtacccagagcagctgcaatgctgctttcaatgacctctggagacttgacctaaacagcaaagagtggatccgacctttggcttcagggtcctatccttcccccaaagctggagcaactctggtcgtgtacaaggacttgctagtgctgtttggtggctggacgcggccaagcccttatcccctacaccagccagagagattctttgatgaaatacacacttactcaccctctaaaaattggtggaactgcattgtgacaacccatgggccacctcccatggctggccactcctcctgtgtgatagatgataaaatgattgtctttggtggctctttaggatcccggcaaatgagcaatgatgtctgggtccttgaccttgagcagtgggcgtggtccaagccgaacatctctggccccagtcctcatcctcgaggtggccaatctcagattgtcatagatgatgcaactatcttaatcctcggagggtgtggcggtcccaatgctctattcaaggatgcttggttgttgcacatgcattctggtccttgggcctggcagccactcaaggtagaaaatgaagagcatggggccccagaactgtggtgccatccagcttgccgggtgggacagtgtgtggtggtcttcagccaggctcctagtgggagagccccactcagccccagtttgaactctcgcccatcacctatcagtgccactcctccagctctcgttcctgaaacccgagagtaccgctctcagtctccagtaagaagcatggatgaagctccttgtgttaacggccgctggggaacactgagacccagggctcaaaggcagactccttcaggttcccgggaagggagcctttccccagccagaggagacggctctcctatcctcaatggtgggagtttgtctccaggaacggcagctgtgggtggctcttctttggacagtcctgtacaggccatatctccaagtactccatctgctcctgaaggatacgacctgaaaataggactttctttggccccccgacgaggatcactaccagatcagaaagatctgagattaggatccatagatctgaattgggatctgaaacccgcttccagtagtaatcccatggatggcatggacaataggacagttgggggaagtatgagacaccctcctgaacagacaaatggtgtgcataccccacctcacgtggccagtgcccttgcaggggccgtctccccaggtgccctgcgtcggagtctggaagccatcaaagcgatgtcctccaaaggcccctcggcctctgcagcactaagtcctcctcttgggtcttctccaggctctcctgggagccagagtttgagcagtggagaaacagtgcccatccctcgcccagggcctgcccaaggagatggacattccttacctcccattgctcgccgcctgggccaccaccctccacagtccctaaatgttggcaaacccctataccagagtatgaactgcaagcccatgcagatgtacgtgctggacattaaagacaccaaggagaaggggcgggtcaaatggaaagtatttaatagcagttctgtggttggacctcctgaaaccagcctgcataccgtggtacaaggcaggggtgaactcatcatatttggaggactcatggacaagaaacagaatgtgaagtactatccaaaaacaaacgccttgtactttgtacgagcaaagagataatgtgttctaaacccctttccttttctgtggcttttaatttggaattttccagtgtgtaagcatttggactgagaattgggaaaacaaaattactcccagaagccaaaactctttaattcccaaccgaagtcactccaggctgggatcaaatctccattaagaaaaaaaattatatataaatatatatatatatattatatagccaactctgttgacaaaaaaagggagagatttccatcctggttcagataaagttgttgctgtgttttaacaggggctgggctgcctttttctaccttgctggtaactagaccaagaagttagagaatagactaacatcagtaacttcccaaaagaaactgaagagccccctgtaaatctttatgtggccttcttggagttaaaaaatgaaagggcatatgtaagttgcaaaggtggagggttttagactctcatgcttcaggtgctgtcggggtaaaagtaactgtttttccccttctcttaaaaccacagaggacctgtgacagctctgcagaaatgccagtgcctggccccctcttgccttttatggctgaggaaagttacccaacaaaggattttattccacatttgtgtgccgggtcattgtgaaataatgtttatgcagccaacatctgaccgcctagtagtgtccattggtctttggagtgcttcttgtgtgtctcagaaaacattttgtgtctgattgtggaaatttctgacaatcaatcatatttggtggcaagttgccaaaaaacatatttattctcctctttcttcccttagaacatggtacttggaaactgccttttccattcacttacaggctgcttttttcttctaccttttttcttttcttttttttttttcatatgtggtgaagtcctaaaacctgtctgactttctgtttcttttacaaagctcaggtgcctacagaaatcagaagctgcttagaaatacttgtggaaccctttccctggtgtcactagggggccagtagggaattctaagatgccaatattgtgagaaatctttgaagcaagcatcaaaagatactgttttttccctatgggcttctttttacttccaaagcacattgagcacactcatcccatatttgtagaatgtggaaattgattctggaagggaattccaataacagttctttttagaaatgtttttttccttgtggtgacatatattcctcttcctggctattggcaggtgatggagttgagaatcatgtacttgacttcttgacgcatggctgacctcagaaacagctccatcctttgcacttgtcttcttcatgtgtcacccaaatagggcttgggtttttactttcacttcatttctgagattaaggtgtaaccaagtagagcatttctttgcttgatacagaaagttactagtctcaaccatggcctgggcataggagatgtcaaaataagtttatttcaaatggcaccatttaaatagggatttttggtgatttctcatcagtggaaagaggatttttgttttgcctttgttttgttttgaaatttaaatcctaatttcaaaacatcaccttgccaccctgacactcctctttttattattagcgtttctcaggcacaaagcctgctgcagctggccctgggtcctggctttcagccagcatctggcagcctaagtgtactgataagtgtgttttctcctgttacatcatgctgaatcctttcccttagccattagcttttatgatgtggtcttcgtaggaaagccaccctggtgccaagcctagcttgtggggaggggtatgtgttccagaaactgctctttgtgttcccttcaatgaggaaacaacatgtgtctacttatgtggcatccaactgcttggagctccacacttccctttcgcgactcaggctctggtgctgttgccaatccttgcttggcaaagactgttcgatcatgtggggtccttatttacaagggaaagctgggccagaaggctagcaattcaggtgttaccgctattgctgtaccttgtgttaggacattgtgtttgtgcatggactgtgcctccaaactcagtagttcctatctaaatataaagtatattagaaacctgaaagtacagaatctcaaccttacagtctttcccttagtcctgtggccttcctaagccagctgttaacgtgttgattccttccacttcccccaagtaggcaggcaacagatatgttgattgtcttagaaagtaatctggttcctctgaactccattgaattccagtttgacgcatactgcctggaaccagactgtttgcttacagctttttaagaaaaatctgccttgtctgcccccattatggttggtcttggtagctcctgggcactgtgggcgtgtaccatgggaaagtgattcaacacagtgaaggtgattgtctcctcaggcctcctgaagccacctgtgcggtgggacttcacgtgtctcggccaaggcgagcatttccacaatgccgtggatgctgcagtcaggccagattgaaccatgaccccatttttcacatgataccaattttgtcttaaaattcactgagaaaaatgagactaaattttttttaaccctcaggagcacctgaagcaaatatttatccgtatttattgaaaattcattttgtttctacttgaagctttaaccccttccattcctgcaagtgtgccttttgagagctcccatggcctagtgacttcactggtcaccttgtccatcttacttaagaattttagtctctccctaccctcttggacagagcttcctgttctcttatttcacaggttatgcagcagagcgggttttgtgttttcattcctatttccacccttcatttggttggtggactccacaacctcaccctaccctacactttgggagcacaaatttggtgttgaaacaagcttaaatttcattttagggcatactgggcttactctcctcccagctgtctgtggattgatttgattttaatgttcgagttttacagcaacagctgaaaaccatgaactattctaggaactgtgttggaactctttaaaataaagaaaagaggaggaggaggaggaagaaagaaaaccaacttaagaagccttgactttggaggacagaaagccaccagccaatggagaacaaagagatgtttccctttcctttctttcaccttgtcattctgggtttccttctgcttcactctttccttcccccttaaaagtggtattcctggttggtctgtctgtctgtccttgtccttgtggtgatcctggcatggtgatatgctccactttgcattatccatggtctcttaccagcgcacaagtcagtggggaggatctaaccacgcctggtggtgaggaagctgaatttccaggcctgcgtcccatgtagcctctccatgaactgcagaaggcatgttctgcatggttaccagtaagtggctccctctcaccgtgttcattgtcaaatgagagcaaactttaggtgttggctccattgtacactctacttgctctgctcccctccctccaaccagggttcatgtcagtgcacaccccatgtgccctggcgaagctggtgctgtgagtgatgtttcccatacaactcagggatgccaggtggcttaccctgagatagtcattttgggcacataacagtgtaggaatgaaacatggatttcattgatatttaaatctgtcaatttcattttttgttaatgttttcccctgatgactttttagcaatttaacaaataaaatggacaattgtcttaactgttttattagcaaaaaaagaa

SEQ ID NO: 307599 - DNA, 6131 bp, Homo sapiens
  misc_feature (25)..(25): n is a, c, g, or t
agcgggtcttctcccggcctgagcngcagcagctgcggcggcggcggcgtttgagtggaggaagatggcggctccgggcggctcggggtcccgccagctgtgaggagccccgagcacggctgtcgcggcctgaggcagagcgcctctgctctggccctgtccctggctccctcattaccgtcgccagcggagcgaacccgagagcgtggagcgggctgggccagctgttgagtggaatgtcatggccagctcctcggacagtgaagatgacagtttcatggctgtggaccaggaagaaactgtgctggaagggacaatggatcaagatgaggagccccacccagtattggaggctgaggagactagacataataggtccatgtcggagctgccagaagaggttttggagtatatcctgtcctttctctcaccgtatcaggaacacaaaactgcggcccttgtctgcaaacagtggtatcgacttatcaaaggtgcatgctattatgatgctaatcagtctatgtatgtgtttggaggctgtacccagagcagctgcaatgctgctttcaatgacctctggagacttgacctaaacagcaaagagtggatccgacctttggcttcagggtcctatccttcccccaaagctggagcaactctggtcgtgtacaaggacttgctagtgctgtttggtggctggacgcggccaagcccttatcccctacaccagccagagagattctttgatgaaatacacacttactcaccctctaaaaattggtggaactgcattgtgacaacccatgggccacctcccatggctggccactcctcctgtgtgatagatgataaaatgattgtctttggtggctctttaggatcccggcaaatgagcaatgatgtctgggtccttgaccttgagcagtgggcgtggtccaagccgaacatctctggccccagtcctcatcctcgaggtggccaatctcagattgtcatagatgatgcaactatcttaatcctcggagggtgtggcggtcccaatgctctattcaaggatgcttggttgttgcacatgcattctggtccttgggcctggcagccactcaaggtagaaaatgaagagcatggggccccagaactgtggtgccatccagcttgccgggtgggacagtgtgtggtggtcttcagccaggctcctagtgggagagccccactcagccccagtttgaactctcgcccatcacctatcagtgccactcctccagctctcgttcctgaaacccgagagtaccgctctcagtctccagtaagaagcatggatgaagctccttgtgttaacggccgctggggaacactgagacccagggctcaaaggcagactccttcaggttcccgggaagggagcctttccccagccagaggagacggctctcctatcctcaatggtgggagtttgtctccaggaacggcagctgtgggtggctcttctttggacagtcctgtacaggccatatctccaagtactccatctgctcctgaaggatacgacctgaaaataggactttctttggccccccgacgaggatcactaccagatcagaaagatctgagattaggatccatagatctgaattgggatctgaaacccgcttccagtagtaatcccatggatggcatggacaataggacagttgggggaagtatgagacaccctcctgaacagacaaatggtgtgcataccccacctcacgtggccagtgcccttgcaggggccgtctccccaggtgccctgcgtcggagtctggaagccatcaaagcgatgtcctccaaaggcccctcggcctctgcagcactaagtcctcctcttgggtcttctccaggctctcctgggagccagagtttgagcagtggagaaacagtgcccatccctcgcccagggcctgcccaaggagatggacattccttacctcccattgctcgccgcctgggccaccaccctccacagtccctaaatgttggcaaacccctataccagagtatgaactgcaagcccatgcagatgtacgtgctggacattaaagacaccaaggagaaggggcgggtcaaatggaaagtatttaatagcagttctgtggttggacctcctgaaaccagcctgcataccgtggtacaaggcaggggtgaactcatcatatttggaggactcatggacaagaaacagaatgtgaagtactatccaaaaacaaacgccttgtactttgtacgagcaaagagataatgtgttctaaacccctttccttttctgtggcttttaatttggaattttccagtgtgtaagcatttggactgagaattgggaaaacaaaattactcccagaagccaaaactctttaattcccaaccgaagtcactccaggctgggatcaaatctccattaagaaaaaaaattatatataaatatatatatatatattatatagccaactctgttgacaaaaaaagggagagatttccatcctggttcagataaagttgttgctgtgttttaacaggggctgggctgcctttttctaccttgctggtaactagaccaagaagttagagaatagactaacatcagtaacttcccaaaagaaactgaagagccccctgtaaatctttatgtggccttcttggagttaaaaaatgaaagggcatatgtaagttgcaaaggtggagggttttagactctcatgcttcaggtgctgtcggggtaaaagtaactgtttttccccttctcttaaaaccacagaggacctgtgacagctctgcagaaatgccagtgcctggccccctcttgccttttatggctgaggaaagttacccaacaaaggattttattccacatttgtgtgccgggtcattgtgaaataatgtttatgcagccaacatctgaccgcctagtagtgtccattggtctttggagtgcttcttgtgtgtctcagaaaacattttgtgtctgattgtggaaatttctgacaatcaatcatatttggtggcaagttgccaaaaaacatatttattctcctctttcttcccttagaacatggtacttggaaactgccttttccattcacttacaggctgcttttttcttctaccttttttcttttcttttttttttttcatatgtggtgaagtcctaaaacctgtctgactttctgtttcttttacaaagctcaggtgcctacagaaatcagaagctgcttagaaatacttgtggaaccctttccctggtgtcactagggggccagtagggaattctaagatgccaatattgtgagaaatctttgaagcaagcatcaaaagatactgttttttccctatgggcttctttttacttccaaagcacattgagcacactcatcccatatttgtagaatgtggaaattgattctggaagggaattccaataacagttctttttagaaatgtttttttccttgtggtgacatatattcctcttcctggctattggcaggtgatggagttgagaatcatgtacttgacttcttgacgcatggctgacctcagaaacagctccatcctttgcacttgtcttcttcatgtgtcacccaaatagggcttgggtttttactttcacttcatttctgagattaaggtgtaaccaagtagagcatttctttgcttgatacagaaagttactagtctcaaccatggcctgggcataggagatgtcaaaataagtttatttcaaatggcaccatttaaatagggatttttggtgatttctcatcagtggaaagaggatttttgttttgcctttgttttgttttgaaatttaaatcctaatttcaaaacatcaccttgccaccctgacactcctctttttattattagcgtttctcaggcacaaagcctgctgcagctggccctgggtcctggctttcagccagcatctggcagcctaagtgtactgataagtgtgttttctcctgttacatcatgctgaatcctttcccttagccattagcttttatgatgtggtcttcgtaggaaagccaccctggtgccaagcctagcttgtggggaggggtatgtgttccagaaactgctctttgtgttcccttcaatgaggaaacaacatgtgtctacttatgtggcatccaactgcttggagctccacacttccctttcgcgactcaggctctggtgctgttgccaatccttgcttggcaaagactgttcgatcatgtggggtccttatttacaagggaaagctgggccagaaggctagcaattcaggtgttaccgctattgctgtaccttgtgttaggacattgtgtttgtgcatggactgtgcctccaaactcagtagttcctatctaaatataaagtatattagaaacctgaaagtacagaatctcaaccttacagtctttcccttagtcctgtggccttcctaagccagctgttaacgtgttgattccttccacttcccccaagtaggcaggcaacagatatgttgattgtcttagaaagtaatctggttcctctgaactccattgaattccagtttgacgcatactgcctggaaccagactgtttgcttacagctttttaagaaaaatctgccttgtctgcccccattatggttggtcttggtagctcctgggcactgtgggcgtgtaccatgggaaagtgattcaacacagtgaaggtgattgtctcctcaggcctcctgaagccacctgtgcggtgggacttcacgtgtctcggccaaggcgagcatttccacaatgccgtggatgctgcagtcaggccagattgaaccatgaccccatttttcacatgataccaattttgtcttaaaattcactgagaaaaatgagactaaattttttttaaccctcaggagcacctgaagcaaatatttatccgtatttattgaaaattcattttgtttctacttgaagctttaaccccttccattcctgcaagtgtgccttttgagagctcccatggcctagtgacttcactggtcaccttgtccatcttacttaagaattttagtctctccctaccctcttggacagagcttcctgttctcttatttcacaggttatgcagcagagcgggttttgtgttttcattcctatttccacccttcatttggttggtggactccacaacctcaccctaccctacactttgggagcacaaatttggtgttgaaacaagcttaaatttcattttagggcatactgggcttactctcctcccagctgtctgtggattgatttgattttaatgttcgagttttacagcaacagctgaaaaccatgaactattctaggaactgtgttggaactctttaaaataaagaaaagaggaggaggaggaggaagaaagaaaaccaacttaagaagccttgactttggaggacagaaagccaccagccaatggagaacaaagagatgtttccctttcctttctttcaccttgtcattctgggtttccttctgcttcactctttccttcccccttaaaagtggtattcctggttggtctgtctgtctgtccttgtccttgtggtgatcctggcatggtgatatgctccactttgcattatccatggtctcttaccagcgcacaagtcagtggggaggatctaaccacgcctggtggtgaggaagctgaatttccaggcctgcgtcccatgtagcctctccatgaactgcagaaggcatgttctgcatggttaccagtaagtggctccctctcaccgtgttcattgtcaaatgagagcaaactttaggtgttggctccattgtacactctacttgctctgctcccctccctccaaccagggttcatgtcagtgcacaccccatgtgccctggcgaagctggtgctgtgagtgatgtttcccatacaactcagggatgccaggtggcttaccctgagatagtcattttgggcacataacagtgtaggaatgaaacatggatttcattgatatttaaatctgtcaatttcattttttgttaatgttttcccctgatgactttttagcaatttaacaaataaaatggacaattgtcttaactgttttattagcaaaaaaagaa

SEQ ID NO: 307600 - DNA, 5637 bp, Homo sapiens
  misc_feature (25)..(25): n is a, c, g, or t
  misc_feature (5608)..(5608): n is a, c, g, or t
  misc_feature (5621)..(5621): n is a, c, g, or t
  misc_feature (5633)..(5633): n is a, c, g, or t
agcgggtcttctcccggcctgagcngcagcagctgcggcggcggcggcgtttgagtggaggaagatggcggctccgggcggctcggggtcccgccagctgtgaggagccccgagcacggctgtcgcggcctgaggcagagcgcctctgctctggccctgtccctggctccctcattaccgtcgccagcggagcgaacccgagagcgtggagcgggctgggccagagatgggatttcgccatgttgcccacgctggtctcgaactcctgacctaaggtgatctgccggcctcagaatcccaaagtgctgggactacaggtgtgagccactgcacccaaccaagaactactatattttctgttgagtggaatgtcatggccagctcctcggacagtgaagatgacagtttcatggctgtggaccaggaagaaactgtgctggaagggacaatggatcaagatgaggagccccacccagtattggaggctgaggagactagacataataggtccatgtcggagctgccagaagaggttttggagtatatcctgtcctttctctcaccgtatcaggaacacaaaactgcggcccttgtctgcaaacagtggtatcgacttatcaaaggtgtagcccatcagtgttatcatggtttcatgaaggctgtccaggaaggaaacattcagtgggagagccgtacctatccttatcctggaaccccaatcactcagcgcttctcgcacagtgcatgctattatgatgctaatcagtctatgtatgtgtttggaggctgtacccagagcagctgcaatgctgctttcaatgacctctggagacttgacctaaacagcaaagagtggatccgacctttggcttcagggtcctatccttcccccaaagctggagcaactctggtcgtgtacaaggacttgctagtgctgtttggtggctggacgcggccaagcccttatcccctacaccagccagagagattctttgatgaaatacacacttactcaccctctaaaaattggtggaactgcattgtgacaacccatgggccacctcccatggctggccactcctcctgtgtgatagatgataaaatgattgtctttggtggctctttaggatcccggcaaatgagcaatgatgtctgggtccttgaccttgagcagtgggcgtggtccaagccgaacatctctggccccagtcctcatcctcgaggtggccaatctcagattgtcatagatgatgcaactatcttaatcctcggagggtgtggcggtcccaatgctctattcaaggatgcttggttgttgcacatgcattctggtccttgggcctggcagccactcaaggtagaaaatgaagagcatggggccccagaactgtggtgccatccagcttgccgggtgggacagtgtgtggtggtcttcagccaggctcctagtgggagagccccactcagccccagtttgaactctcgcccatcacctatcagtgccactcctccagctctcgttcctgaaacccgagagtaccgctctcagtctccagtaagaagcatggatgaagctccttgtgttaacggccgctggggaacactgagacccagggctcaaaggcagactccttcaggttcccgggaagggagcctttccccagccagaggagacggctctcctatcctcaatggtgggagtttgtctccaggaacggcagctgtgggtggctcttctttggacagtcctgtacaggccatatctccaagtactccatctgctcctgaaggatacgacctgaaaataggactttctttggccccccgacgaggatcactaccagatcagaaagatctgagattaggatccatagatctgaattgggatctgaaacccgcttccagtagtaatcccatggatggcatggacaataggacagttgggggaagtatgagacaccctcctgaacagacaaatggtgtgcataccccacctcacgtggccagtgcccttgcaggggccgtctccccaggtgccctgcgtcggagtctggaagccatcaaagcgatgtcctccaaaggcccctcggcctctgcagcactaagtcctcctcttgggtcttctccaggctctcctgggagccagagtttgagcagtggagaaacagtgcccatccctcgcccagggcctgcccaaggagatggacattccttacctcccattgctcgccgcctgggccaccaccctccacagtccctaaatgttggcaaacccctataccagagtatgaactgcaagcccatgcagatgtacgtgctggacattaaagacaccaaggagaaggggcgggtcaaatggaaagtatttaatagcagttctgtggttggacctcctgaaaccagcctgcataccgtggtacaaggcaggggtgaactcatcatatttggaggactcatggacaagaaacagaatgtgaagtactatccaaaaacaaacgccttgtactttgtacgagcaaagagataatgtgttctaaacccctttccttttctgtggcttttaatttggaattttccagtgtgtaagcatttggactgagaattgggaaaacaaaattactcccagaagccaaaactctttaattcccaaccgaagtcactccaggctgggatcaaatctccattaagaaaaaaaattatatataaatatatatatatatattatatagccaactctgttgacaaaaaaagggagagatttccatcctggttcagataaagttgttgctgtgttttaacaggggctgggctgcctttttctaccttgctggtaactagaccaagaagttagagaatagactaacatcagtaacttcccaaaagaaactgaagagccccctgtaaatctttatgtggccttcttggagttaaaaaatgaaagggcatatgtaagttgcaaaggtggagggttttagactctcatgcttcaggtgctgtcggggtaaaagtaactgtttttccccttctcttaaaaccacagaggacctgtgacagctctgcagaaatgccagtgcctggccccctcttgccttttatggctgaggaaagttacccaacaaaggattttattccacatttgtgtgccgggtcattgtgaaataatgtttatgcagccaacatctgaccgcctagtagtgtccattggtctttggagtgcttcttgtgtgtctcagaaaacattttgtgtctgattgtggaaatttctgacaatcaatcatatttggtggcaagttgccaaaaaacatatttattctcctctttcttcccttagaacatggtacttggaaactgccttttccattcacttacaggctgcttttttcttctaccttttttcttttcttttttttttttcatatgtggtgaagtcctaaaacctgtctgactttctgtttcttttacaaagctcaggtgcctacagaaatcagaagctgcttagaaatacttgtggaaccctttccctggtgtcactagggggccagtagggaattctaagatgccaatattgtgagaaatctttgaagcaagcatcaaaagatactgttttttccctatgggcttctttttacttccaaagcacattgagcacactcatcccatatttgtagaatgtggaaattgattctggaagggaattccaataacagttctttttagaaatgtttttttccttgtggtgacatatattcctcttcctggctattggcaggtgatggagttgagaatcatgtacttgacttcttgacgcatggctgacctcagaaacagctccatcctttgcacttgtcttcttcatgtgtcacccaaatagggcttgggtttttactttcacttcatttctgagattaaggtgtaaccaagtagagcatttctttgcttgatacagaaagttactagtctcaaccatggcctgggcataggagatgtcaaaataagtttatttcaaatggcaccatttaaatagggatttttggtgatttctcatcagtggaaagaggatttttgttttgcctttgttttgttttgaaatttaaatcctaatttcaaaacatcaccttgccaccctgacactcctctttttattattagcgtttctcaggcacaaagcctgctgcagctggccctgggtcctggctttcagccagcatctggcagcctaagtgtactgataagtgtgttttctcctgttacatcatgctgaatcctttcccttagccattagcttttatgatgtggtcttcgtaggaaagccaccctggtgccaagcctagcttgtggggaggggtatgtgttccagaaactgctctttgtgttcccttcaatgaggaaacaacatgtgtctacttatgtggcatccaactgcttggagctccacacttccctttcgcgactcaggctctggtgctgttgccaatccttgcttggcaaagactgttcgatcatgtggggtccttatttacaagggaaagctgggccagaaggctagcaattcaggtgttaccgctattgctgtaccttgtgttaggacattgtgtttgtgcatggactgtgcctccaaactcagtagttcctatctaaatataaagtatattagaaacctgaaagtacagaatctcaaccttacagtctttcccttagtcctgtggccttcctaagccagctgttaacgtgttgattccttccacttcccccaagtaggcaggcaacagatatgttgattgtcttagaaagtaatctggttcctctgaactccattgaattccagtttgacgcatactgcctggaaccagactgtttgcttacagctttttaagaaaaatctgccttgtctgcccccattatggttggtcttggtagctcctgggcactgtgggcgtgtaccatgggaaagtgattcaacacagtgaaggtgattgtctcctcaggcctcctgaagccacctgtgcggtgggacttcacgtgtctcggccaaggcgagcatttccacaatgccgtggatgctgcagtcaggccagattgaaccatgaccccatttttcacatgataccaattttgtcttaaaattcactgagaaaaatgagactaaattttttttaaccctcaggagcacctgaagcaaatatttatccgtatttattgaaaattcattttgtttctacttgaagctttaaccccttccattcctgcaagtgtgccttttgagagctcccatggcctagtgacttcactggtcaccttgtccatcttacttaagaattttagtctctccctaccctcttggacagagcttcctgttctcttatttcacaggttatgcagcagagcgggttttgtgttttcattcctatttccacccttcatttggttggtggactccacaacctcaccctaccctacactttgggagcacaaatttggtgttgaaacaagcttaaatttcattttagggcatactgggcttactctcctcccagctgtctgtggattgatttgattttaatgttcgagttttacagcaacagctgaaaaccatgaactattcttggtnaagtggcagacgngatcctctagancact

SEQ ID NO: 307601 - DNA, 6433 bp, Homo sapiens
  misc_feature (25)..(25): n is a, c, g, or t
agcgggtcttctcccggcctgagcngcagcagctgcggcggcggcggcgtttgagtggaggaagatggcggctccgggcggctcggggtcccgccagctgtgaggagccccgagcacggctgtcgcggcctgaggcagagcgcctctgctctggccctgtccctggctccctcattaccgtcgccagcggagcgaacccgagagcgtggagcgggctgggccagagatgggatttcgccatgttgcccacgctggtctcgaactcctgacctaaggtgatctgccggcctcagaatcccaaagtgctgggactacaggtgtgagccactgcacccaaccaagaactactatattttctgttgagtggaatgtcatggccagctcctcggacagtgaagatgacagtttcatggctgtggaccaggaagaaactgtgctggaagggacaatggatcaagatgaggagccccacccagtattggaggctgaggagactagacataataggtccatgtcggagctgccagaagaggttttggagtatatcctgtcctttctctcaccgtatcaggaacacaaaactgcggcccttgtctgcaaacagtggtatcgacttatcaaaggtgtagcccatcagtgttatcatggtttcatgaaggctgtccaggaaggaaacattcagtgggagagccgtacctatccttatcctggaaccccaatcactcagcgcttctcgcacagtgcatgctattatgatgctaatcagtctatgtatgtgtttggaggctgtacccagagcagctgcaatgctgctttcaatgacctctggagacttgacctaaacagcaaagagtggatccgacctttggcttcagggtcctatccttcccccaaagctggagcaactctggtcgtgtacaaggacttgctagtgctgtttggtggctggacgcggccaagcccttatcccctacaccagccagagagattctttgatgaaatacacacttactcaccctctaaaaattggtggaactgcattgtgacaacccatgggccacctcccatggctggccactcctcctgtgtgatagatgataaaatgattgtctttggtggctctttaggatcccggcaaatgagcaatgatgtctgggtccttgaccttgagcagtgggcgtggtccaagccgaacatctctggccccagtcctcatcctcgaggtggccaatctcagattgtcatagatgatgcaactatcttaatcctcggagggtgtggcggtcccaatgctctattcaaggatgcttggttgttgcacatgcattctggtccttgggcctggcagccactcaaggtagaaaatgaagagcatggggccccagaactgtggtgccatccagcttgccgggtgggacagtgtgtggtggtcttcagccaggctcctagtgggagagccccactcagccccagtttgaactctcgcccatcacctatcagtgccactcctccagctctcgttcctgaaacccgagagtaccgctctcagtctccagtaagaagcatggatgaagctccttgtgttaacggccgctggggaacactgagacccagggctcaaaggcagactccttcaggttcccgggaagggagcctttccccagccagaggagacggctctcctatcctcaatggtgggagtttgtctccaggaacggcagctgtgggtggctcttctttggacagtcctgtacaggccatatctccaagtactccatctgctcctgaaggatacgacctgaaaataggactttctttggccccccgacgaggatcactaccagatcagaaagatctgagattaggatccatagatctgaattgggatctgaaacccgcttccagtagtaatcccatggatggcatggacaataggacagttgggggaagtatgagacaccctcctgaacagacaaatggtgtgcataccccacctcacgtggccagtgcccttgcaggggccgtctccccaggtgccctgcgtcggagtctggaagccatcaaagcgatgtcctccaaaggcccctcggcctctgcagcactaagtcctcctcttgggtcttctccaggctctcctgggagccagagtttgagcagtggagaaacagtgcccatccctcgcccagggcctgcccaaggagatggacattccttacctcccattgctcgccgcctgggccaccaccctccacagtccctaaatgttggcaaacccctataccagagtatgaactgcaagcccatgcagatgtacgtgctggacattaaagacaccaaggagaaggggcgggtcaaatggaaagtatttaatagcagttctgtggttggacctcctgaaaccagcctgcataccgtggtacaaggcaggggtgaactcatcatatttggaggactcatggacaagaaacagaatgtgaagtactatccaaaaacaaacgccttgtactttgtacgagcaaagagataatgtgttctaaacccctttccttttctgtggcttttaatttggaattttccagtgtgtaagcatttggactgagaattgggaaaacaaaattactcccagaagccaaaactctttaattcccaaccgaagtcactccaggctgggatcaaatctccattaagaaaaaaaattatatataaatatatatatatatattatatagccaactctgttgacaaaaaaagggagagatttccatcctggttcagataaagttgttgctgtgttttaacaggggctgggctgcctttttctaccttgctggtaactagaccaagaagttagagaatagactaacatcagtaacttcccaaaagaaactgaagagccccctgtaaatctttatgtggccttcttggagttaaaaaatgaaagggcatatgtaagttgcaaaggtggagggttttagactctcatgcttcaggtgctgtcggggtaaaagtaactgtttttccccttctcttaaaaccacagaggacctgtgacagctctgcagaaatgccagtgcctggccccctcttgccttttatggctgaggaaagttacccaacaaaggattttattccacatttgtgtgccgggtcattgtgaaataatgtttatgcagccaacatctgaccgcctagtagtgtccattggtctttggagtgcttcttgtgtgtctcagaaaacattttgtgtctgattgtggaaatttctgacaatcaatcatatttggtggcaagttgccaaaaaacatatttattctcctctttcttcccttagaacatggtacttggaaactgccttttccattcacttacaggctgcttttttcttctaccttttttcttttcttttttttttttcatatgtggtgaagtcctaaaacctgtctgactttctgtttcttttacaaagctcaggtgcctacagaaatcagaagctgcttagaaatacttgtggaaccctttccctggtgtcactagggggccagtagggaattctaagatgccaatattgtgagaaatctttgaagcaagcatcaaaagatactgttttttccctatgggcttctttttacttccaaagcacattgagcacactcatcccatatttgtagaatgtggaaattgattctggaagggaattccaataacagttctttttagaaatgtttttttccttgtggtgacatatattcctcttcctggctattggcaggtgatggagttgagaatcatgtacttgacttcttgacgcatggctgacctcagaaacagctccatcctttgcacttgtcttcttcatgtgtcacccaaatagggcttgggtttttactttcacttcatttctgagattaaggtgtaaccaagtagagcatttctttgcttgatacagaaagttactagtctcaaccatggcctgggcataggagatgtcaaaataagtttatttcaaatggcaccatttaaatagggatttttggtgatttctcatcagtggaaagaggatttttgttttgcctttgttttgttttgaaatttaaatcctaatttcaaaacatcaccttgccaccctgacactcctctttttattattagcgtttctcaggcacaaagcctgctgcagctggccctgggtcctggctttcagccagcatctggcagcctaagtgtactgataagtgtgttttctcctgttacatcatgctgaatcctttcccttagccattagcttttatgatgtggtcttcgtaggaaagccaccctggtgccaagcctagcttgtggggaggggtatgtgttccagaaactgctctttgtgttcccttcaatgaggaaacaacatgtgtctacttatgtggcatccaactgcttggagctccacacttccctttcgcgactcaggctctggtgctgttgccaatccttgcttggcaaagactgttcgatcatgtggggtccttatttacaagggaaagctgggccagaaggctagcaattcaggtgttaccgctattgctgtaccttgtgttaggacattgtgtttgtgcatggactgtgcctccaaactcagtagttcctatctaaatataaagtatattagaaacctgaaagtacagaatctcaaccttacagtctttcccttagtcctgtggccttcctaagccagctgttaacgtgttgattccttccacttcccccaagtaggcaggcaacagatatgttgattgtcttagaaagtaatctggttcctctgaactccattgaattccagtttgacgcatactgcctggaaccagactgtttgcttacagctttttaagaaaaatctgccttgtctgcccccattatggttggtcttggtagctcctgggcactgtgggcgtgtaccatgggaaagtgattcaacacagtgaaggtgattgtctcctcaggcctcctgaagccacctgtgcggtgggacttcacgtgtctcggccaaggcgagcatttccacaatgccgtggatgctgcagtcaggccagattgaaccatgaccccatttttcacatgataccaattttgtcttaaaattcactgagaaaaatgagactaaattttttttaaccctcaggagcacctgaagcaaatatttatccgtatttattgaaaattcattttgtttctacttgaagctttaaccccttccattcctgcaagtgtgccttttgagagctcccatggcctagtgacttcactggtcaccttgtccatcttacttaagaattttagtctctccctaccctcttggacagagcttcctgttctcttatttcacaggttatgcagcagagcgggttttgtgttttcattcctatttccacccttcatttggttggtggactccacaacctcaccctaccctacactttgggagcacaaatttggtgttgaaacaagcttaaatttcattttagggcatactgggcttactctcctcccagctgtctgtggattgatttgattttaatgttcgagttttacagcaacagctgaaaaccatgaactattctaggaactgtgttggaactctttaaaataaagaaaagaggaggaggaggaggaagaaagaaaaccaacttaagaagccttgactttggaggacagaaagccaccagccaatggagaacaaagagatgtttccctttcctttctttcaccttgtcattctgggtttccttctgcttcactctttccttcccccttaaaagtggtattcctggttggtctgtctgtctgtccttgtccttgtggtgatcctggcatggtgatatgctccactttgcattatccatggtctcttaccagcgcacaagtcagtggggaggatctaaccacgcctggtggtgaggaagctgaatttccaggcctgcgtcccatgtagcctctccatgaactgcagaaggcatgttctgcatggttaccagtggcatccaaggctctgctgtctgtccacagcatccggacctctcatctgtctacacccattgcttcaggcttggtccctccgccgtcagtaatgtccagcttcactcaggccgctcacctgcgctttacattccaacatctgctgaactcctgcttctccctgcctctaaatggaccccaactgctcctgctcgcctgatggttcctgcgcctgtgccggctcctgcaaatgaaaagagtgcacatgcacctcctgcaagaagagctgctgctcctgctgccctgtgggctgtgccaagtgtgcccagggctgcatctgcaaagggacgtcggacaactgcagctgctgtgcctgatgccaggacagccctgctctcagatgtaaatagagcaaccttataaacctggatttttt

SEQ ID NO: 307602 - DNA, 6360 bp, Homo sapiens
  misc_feature (25)..(25): n is a, c, g, or t
agcgggtcttctcccggcctgagcngcagcagctgcggcggcggcggcgtttgagtggaggaagatggcggctccgggcggctcggggtcccgccagctgtgaggagccccgagcacggctgtcgcggcctgaggcagagcgcctctgctctggccctgtccctggctccctcattaccgtcgccagcggagcgaacccgagagcgtggagcgggctgggccagagatgggatttcgccatgttgcccacgctggtctcgaactcctgacctaaggtgatctgccggcctcagaatcccaaagtgctgggactacaggtgtgagccactgcacccaaccaagaactactatattttctgttgagtggaatgtcatggccagctcctcggacagtgaagatgacagtttcatggctgtggaccaggaagaaactgtgctggaagggacaatggatcaagatgaggagccccacccagtattggaggctgaggagactagacataataggtccatgtcggagctgccagaagaggttttggagtatatcctgtcctttctctcaccgtatcaggaacacaaaactgcggcccttgtctgcaaacagtggtatcgacttatcaaaggtgtagcccatcagtgttatcatggtttcatgaaggctgtccaggaaggaaacattcagtgggagagccgtacctatccttatcctggaaccccaatcactcagcgcttctcgcacagtgcatgctattatgatgctaatcagtctatgtatgtgtttggaggctgtacccagagcagctgcaatgctgctttcaatgacctctggagacttgacctaaacagcaaagagtggatccgacctttggcttcagggtcctatccttcccccaaagctggagcaactctggtcgtgtacaaggacttgctagtgctgtttggtggctggacgcggccaagcccttatcccctacaccagccagagagattctttgatgaaatacacacttactcaccctctaaaaattggtggaactgcattgtgacaacccatgggccacctcccatggctggccactcctcctgtgtgatagatgataaaatgattgtctttggtggctctttaggatcccggcaaatgagcaatgatgtctgggtccttgaccttgagcagtgggcgtggtccaagccgaacatctctggccccagtcctcatcctcgaggtggccaatctcagattgtcatagatgatgcaactatcttaatcctcggagggtgtggcggtcccaatgctctattcaaggatgcttggttgttgcacatgcattctggtccttgggcctggcagccactcaaggtagaaaatgaagagcatggggccccagaactgtggtgccatccagcttgccgggtgggacagtgtgtggtggtcttcagccaggctcctagtgggagagccccactcagccccagtttgaactctcgcccatcacctatcagtgccactcctccagctctcgttcctgaaacccgagagtaccgctctcagtctccagtaagaagcatggatgaagctccttgtgttaacggccgctggggaacactgagacccagggctcaaaggcagactccttcaggttcccgggaagggagcctttccccagccagaggagacggctctcctatcctcaatggtgggagtttgtctccaggaacggcagctgtgggtggctcttctttggacagtcctgtacaggccatatctccaagtactccatctgctcctgaaggatacgacctgaaaataggactttctttggccccccgacgaggatcactaccagatcagaaagatctgagattaggatccatagatctgaattgggatctgaaacccgcttccagtagtaatcccatggatggcatggacaataggacagttgggggaagtatgagacaccctcctgaacagacaaatggtgtgcataccccacctcacgtggccagtgcccttgcaggggccgtctccccaggtgccctgcgtcggagtctggaagccatcaaagcgatgtcctccaaaggcccctcggcctctgcagcactaagtcctcctcttgggtcttctccaggctctcctgggagccagagtttgagcagtggagaaacagtgcccatccctcgcccagggcctgcccaaggagatggacattccttacctcccattgctcgccgcctgggccaccaccctccacagtccctaaatgttggcaaacccctataccagagtatgaactgcaagcccatgcagatgtacgtgctggacattaaagacaccaaggagaaggggcgggtcaaatggaaagtatttaatagcagttctgtggttggacctcctgaaaccagcctgcataccgtggtacaaggcaggggtgaactcatcatatttggaggactcatggacaagaaacagaatgtgaagtactatccaaaaacaaacgccttgtactttgtacgagcaaagagataatgtgttctaaacccctttccttttctgtggcttttaatttggaattttccagtgtgtaagcatttggactgagaattgggaaaacaaaattactcccagaagccaaaactctttaattcccaaccgaagtcactccaggctgggatcaaatctccattaagaaaaaaaattatatataaatatatatatatatattatatagccaactctgttgacaaaaaaagggagagatttccatcctggttcagataaagttgttgctgtgttttaacaggggctgggctgcctttttctaccttgctggtaactagaccaagaagttagagaatagactaacatcagtaacttcccaaaagaaactgaagagccccctgtaaatctttatgtggccttcttggagttaaaaaatgaaagggcatatgtaagttgcaaaggtggagggttttagactctcatgcttcaggtgctgtcggggtaaaagtaactgtttttccccttctcttaaaaccacagaggacctgtgacagctctgcagaaatgccagtgcctggccccctcttgccttttatggctgaggaaagttacccaacaaaggattttattccacatttgtgtgccgggtcattgtgaaataatgtttatgcagccaacatctgaccgcctagtagtgtccattggtctttggagtgcttcttgtgtgtctcagaaaacattttgtgtctgattgtggaaatttctgacaatcaatcatatttggtggcaagttgccaaaaaacatatttattctcctctttcttcccttagaacatggtacttggaaactgccttttccattcacttacaggctgcttttttcttctaccttttttcttttcttttttttttttcatatgtggtgaagtcctaaaacctgtctgactttctgtttcttttacaaagctcaggtgcctacagaaatcagaagctgcttagaaatacttgtggaaccctttccctggtgtcactagggggccagtagggaattctaagatgccaatattgtgagaaatctttgaagcaagcatcaaaagatactgttttttccctatgggcttctttttacttccaaagcacattgagcacactcatcccatatttgtagaatgtggaaattgattctggaagggaattccaataacagttctttttagaaatgtttttttccttgtggtgacatatattcctcttcctggctattggcaggtgatggagttgagaatcatgtacttgacttcttgacgcatggctgacctcagaaacagctccatcctttgcacttgtcttcttcatgtgtcacccaaatagggcttgggtttttactttcacttcatttctgagattaaggtgtaaccaagtagagcatttctttgcttgatacagaaagttactagtctcaaccatggcctgggcataggagatgtcaaaataagtttatttcaaatggcaccatttaaatagggatttttggtgatttctcatcagtggaaagaggatttttgttttgcctttgttttgttttgaaatttaaatcctaatttcaaaacatcaccttgccaccctgacactcctctttttattattagcgtttctcaggcacaaagcctgctgcagctggccctgggtcctggctttcagccagcatctggcagcctaagtgtactgataagtgtgttttctcctgttacatcatgctgaatcctttcccttagccattagcttttatgatgtggtcttcgtaggaaagccaccctggtgccaagcctagcttgtggggaggggtatgtgttccagaaactgctctttgtgttcccttcaatgaggaaacaacatgtgtctacttatgtggcatccaactgcttggagctccacacttccctttcgcgactcaggctctggtgctgttgccaatccttgcttggcaaagactgttcgatcatgtggggtccttatttacaagggaaagctgggccagaaggctagcaattcaggtgttaccgctattgctgtaccttgtgttaggacattgtgtttgtgcatggactgtgcctccaaactcagtagttcctatctaaatataaagtatattagaaacctgaaagtacagaatctcaaccttacagtctttcccttagtcctgtggccttcctaagccagctgttaacgtgttgattccttccacttcccccaagtaggcaggcaacagatatgttgattgtcttagaaagtaatctggttcctctgaactccattgaattccagtttgacgcatactgcctggaaccagactgtttgcttacagctttttaagaaaaatctgccttgtctgcccccattatggttggtcttggtagctcctgggcactgtgggcgtgtaccatgggaaagtgattcaacacagtgaaggtgattgtctcctcaggcctcctgaagccacctgtgcggtgggacttcacgtgtctcggccaaggcgagcatttccacaatgccgtggatgctgcagtcaggccagattgaaccatgaccccatttttcacatgataccaattttgtcttaaaattcactgagaaaaatgagactaaattttttttaaccctcaggagcacctgaagcaaatatttatccgtatttattgaaaattcattttgtttctacttgaagctttaaccccttccattcctgcaagtgtgccttttgagagctcccatggcctagtgacttcactggtcaccttgtccatcttacttaagaattttagtctctccctaccctcttggacagagcttcctgttctcttatttcacaggttatgcagcagagcgggttttgtgttttcattcctatttccacccttcatttggttggtggactccacaacctcaccctaccctacactttgggagcacaaatttggtgttgaaacaagcttaaatttcattttagggcatactgggcttactctcctcccagctgtctgtggattgatttgattttaatgttcgagttttacagcaacagctgaaaaccatgaactattctaggaactgtgttggaactctttaaaataaagaaaagaggaggaggaggaggaagaaagaaaaccaacttaagaagccttgactttggaggacagaaagccaccagccaatggagaacaaagagatgtttccctttcctttctttcaccttgtcattctgggtttccttctgcttcactctttccttcccccttaaaagtggtattcctggttggtctgtctgtctgtccttgtccttgtggtgatcctggcatggtgatatgctccactttgcattatccatggtctcttaccagcgcacaagtcagtggggaggatctaaccacgcctggtggtgaggaagctgaatttccaggcctgcgtcccatgtagcctctccatgaactgcagaaggcatgttctgcatggttaccagtggcatccaaggctctgctgtctgtccacagcatccggacctctcatctgtctacacccattgcttcaggcttggtccctccgccgtcagtaatgtccagcttcactcaggccgctcacctgcgctttacattccaacatctgctgtgagtgtgtcctctctgggcagccccccaccctccctcactccccaggggctcctcctctgaccctgtgcgcttcctccatgcttcccccacagttaggggcaccaccatccatccagtcacctgggaatgatcccagggtcaggtgatctgaggatggagaattgaccactgagcttggtggcgaggctggtgccc

SEQ ID NO: 307603 - DNA, 5410 bp, Homo sapiens
tgtcatttctcaagagaatcctgcattttatgtggttgacattcatgttaatatttgatcaacaaagaatgtatcctttcaggtgaattatcagtaatttattcacagggatcagaattgatatgtttttaggagaatggagaggttatggtaactagaatattcccatttgggagctaggtaggctattctcatataccagtgaagcatagaaagtcagaaacctgtgtctttgtaggtttattttcaatgtcttcccctcctcagattgtcatagatgatgcaactatcttaatcctcggagggtgtggcggtcccaatgctctattcaaggatgcttggttgttgcacatgcattctggtccttgggcctggcagccactcaaggtagaaaatgaagagcatggggccccagaactgtggtgccatccagcttgccgggtgggacagtgtgtggtggtcttcagccaggctcctagtgggagagccccactcagccccagtttgaactctcgcccatcacctatcagtgccactcctccagctctcgttcctgaaacccgagagtaccgctctcagtctccagtaagaagcatggatgaagctccttgtgttaacggccgctggggaacactgagacccagggctcaaaggcagactccttcaggttcccgggaagggagcctttccccagccagaggagacggctctcctatcctcaatggtgggagtttgtctccaggaacggcagctgtgggtggctcttctttggacagtcctgtacaggccatatctccaagtactccatctgctcctgaaggatacgacctgaaaataggactttctttggccccccgacgaggatcactaccagatcagaaagatctgagattaggatccatagatctgaattgggatctgaaacccgcttccagtagtaatcccatggatggcatggacaataggacagttgggggaagtatgagacaccctcctgaacagacaaatggtgtgcataccccacctcacgtggccagtgcccttgcaggggccgtctccccaggtgccctgcgtcggagtctggaagccatcaaagcgatgtcctccaaaggcccctcggcctctgcagcactaagtcctcctcttgggtcttctccaggctctcctgggagccagagtttgagcagtggagaaacagtgcccatccctcgcccagggcctgcccaaggagatggacattccttacctcccattgctcgccgcctgggccaccaccctccacagtccctaaatgttggcaaacccctataccagagtatgaactgcaagcccatgcagatgtacgtgctggacattaaagacaccaaggagaaggggcgggtcaaatggaaagtatttaatagcagttctgtggttggacctcctgaaaccagcctgcataccgtggtacaaggcaggggtgaactcatcatatttggaggactcatggacaagaaacagaatgtgaagtactatccaaaaacaaacgccttgtactttgtacgagcaaagagataatgtgttctaaacccctttccttttctgtggcttttaatttggaattttccagtgtgtaagcatttggactgagaattgggaaaacaaaattactcccagaagccaaaactctttaattcccaaccgaagtcactccaggctgggatcaaatctccattaagaaaaaaaattatatataaatatatatatatatattatatagccaactctgttgacaaaaaaagggagagatttccatcctggttcagataaagttgttgctgtgttttaacaggggctgggctgcctttttctaccttgctggtaactagaccaagaagttagagaatagactaacatcagtaacttcccaaaagaaactgaagagccccctgtaaatctttatgtggccttcttggagttaaaaaatgaaagggcatatgtaagttgcaaaggtggagggttttagactctcatgcttcaggtgctgtcggggtaaaagtaactgtttttccccttctcttaaaaccacagaggacctgtgacagctctgcagaaatgccagtgcctggccccctcttgccttttatggctgaggaaagttacccaacaaaggattttattccacatttgtgtgccgggtcattgtgaaataatgtttatgcagccaacatctgaccgcctagtagtgtccattggtctttggagtgcttcttgtgtgtctcagaaaacattttgtgtctgattgtggaaatttctgacaatcaatcatatttggtggcaagttgccaaaaaacatatttattctcctctttcttcccttagaacatggtacttggaaactgccttttccattcacttacaggctgcttttttcttctaccttttttcttttcttttttttttttcatatgtggtgaagtcctaaaacctgtctgactttctgtttcttttacaaagctcaggtgcctacagaaatcagaagctgcttagaaatacttgtggaaccctttccctggtgtcactagggggccagtagggaattctaagatgccaatattgtgagaaatctttgaagcaagcatcaaaagatactgttttttccctatgggcttctttttacttccaaagcacattgagcacactcatcccatatttgtagaatgtggaaattgattctggaagggaattccaataacagttctttttagaaatgtttttttccttgtggtgacatatattcctcttcctggctattggcaggtgatggagttgagaatcatgtacttgacttcttgacgcatggctgacctcagaaacagctccatcctttgcacttgtcttcttcatgtgtcacccaaatagggcttgggtttttactttcacttcatttctgagattaaggtgtaaccaagtagagcatttctttgcttgatacagaaagttactagtctcaaccatggcctgggcataggagatgtcaaaataagtttatttcaaatggcaccatttaaatagggatttttggtgatttctcatcagtggaaagaggatttttgttttgcctttgttttgttttgaaatttaaatcctaatttcaaaacatcaccttgccaccctgacactcctctttttattattagcgtttctcaggcacaaagcctgctgcagctggccctgggtcctggctttcagccagcatctggcagcctaagtgtactgataagtgtgttttctcctgttacatcatgctgaatcctttcccttagccattagcttttatgatgtggtcttcgtaggaaagccaccctggtgccaagcctagcttgtggggaggggtatgtgttccagaaactgctctttgtgttcccttcaatgaggaaacaacatgtgtctacttatgtggcatccaactgcttggagctccacacttccctttcgcgactcaggctctggtgctgttgccaatccttgcttggcaaagactgttcgatcatgtggggtccttatttacaagggaaagctgggccagaaggctagcaattcaggtgttaccgctattgctgtaccttgtgttaggacattgtgtttgtgcatggactgtgcctccaaactcagtagttcctatctaaatataaagtatattagaaacctgaaagtacagaatctcaaccttacagtctttcccttagtcctgtggccttcctaagccagctgttaacgtgttgattccttccacttcccccaagtaggcaggcaacagatatgttgattgtcttagaaagtaatctggttcctctgaactccattgaattccagtttgacgcatactgcctggaaccagactgtttgcttacagctttttaagaaaaatctgccttgtctgcccccattatggttggtcttggtagctcctgggcactgtgggcgtgtaccatgggaaagtgattcaacacagtgaaggtgattgtctcctcaggcctcctgaagccacctgtgcggtgggacttcacgtgtctcggccaaggcgagcatttccacaatgccgtggatgctgcagtcaggccagattgaaccatgaccccatttttcacatgataccaattttgtcttaaaattcactgagaaaaatgagactaaattttttttaaccctcaggagcacctgaagcaaatatttatccgtatttattgaaaattcattttgtttctacttgaagctttaaccccttccattcctgcaagtgtgccttttgagagctcccatggcctagtgacttcactggtcaccttgtccatcttacttaagaattttagtctctccctaccctcttggacagagcttcctgttctcttatttcacaggttatgcagcagagcgggttttgtgttttcattcctatttccacccttcatttggttggtggactccacaacctcaccctaccctacactttgggagcacaaatttggtgttgaaacaagcttaaatttcattttagggcatactgggcttactctcctcccagctgtctgtggattgatttgattttaatgttcgagttttacagcaacagctgaaaaccatgaactattctaggaactgtgttggaactctttaaaataaagaaaagaggaggaggaggaggaagaaagaaaaccaacttaagaagccttgactttggaggacagaaagccaccagccaatggagaacaaagagatgtttccctttcctttctttcaccttgtcattctgggtttccttctgcttcactctttccttcccccttaaaagtggtattcctggttggtctgtctgtctgtccttgtccttgtggtgatcctggcatggtgatatgctccactttgcattatccatggtctcttaccagcgcacaagtcagtggggaggatctaaccacgcctggtggtgaggaagctgaatttccaggcctgcgtcccatgtagcctctccatgaactgcagaaggcatgttctgcatggttaccagtaagtggctccctctcaccgtgttcattgtcaaatgagagcaaactttaggtgttggctccattgtacactctacttgctctgctcccctccctccaaccagggttcatgtcagtgcacaccccatgtgccctggcgaagctggtgctgtgagtgatgtttcccatacaactcagggatgccaggtggcttaccctgagatagtcattttgggcacataacagtgtaggaatgaaacatggatttcattgatatttaaatctgtcaatttcattttttgttaatgttttcccctgatgactttttagcaatttaacaaataaaatggacaattgtcttaactgttttattagcaaaaaaagaa

SEQ ID NO: 307604 - DNA, 5210 bp, Homo sapiens
gtctttcagttaggacgggagagggaggagggagtcaggtttattttcaatgtcttcccctcctcagattgtcatagatgatgcaactatcttaatcctcggagggtgtggcggtcccaatgctctattcaaggatgcttggttgttgcacatgcattctggtccttgggcctggcagccactcaaggtagaaaatgaagagcatggggccccagaactgtggtgccatccagcttgccgggtgggacagtgtgtggtggtcttcagccaggctcctagtgggagagccccactcagccccagtttgaactctcgcccatcacctatcagtgccactcctccagctctcgttcctgaaacccgagagtaccgctctcagtctccagtaagaagcatggatgaagctccttgtgttaacggccgctggggaacactgagacccagggctcaaaggcagactccttcaggttcccgggaagggagcctttccccagccagaggagacggctctcctatcctcaatggtgggagtttgtctccaggaacggcagctgtgggtggctcttctttggacagtcctgtacaggccatatctccaagtactccatctgctcctgaaggatacgacctgaaaataggactttctttggccccccgacgaggatcactaccagatcagaaagatctgagattaggatccatagatctgaattgggatctgaaacccgcttccagtagtaatcccatggatggcatggacaataggacagttgggggaagtatgagacaccctcctgaacagacaaatggtgtgcataccccacctcacgtggccagtgcccttgcaggggccgtctccccaggtgccctgcgtcggagtctggaagccatcaaagcgatgtcctccaaaggcccctcggcctctgcagcactaagtcctcctcttgggtcttctccaggctctcctgggagccagagtttgagcagtggagaaacagtgcccatccctcgcccagggcctgcccaaggagatggacattccttacctcccattgctcgccgcctgggccaccaccctccacagtccctaaatgttggcaaacccctataccagagtatgaactgcaagcccatgcagatgtacgtgctggacattaaagacaccaaggagaaggggcgggtcaaatggaaagtatttaatagcagttctgtggttggacctcctgaaaccagcctgcataccgtggtacaaggcaggggtgaactcatcatatttggaggactcatggacaagaaacagaatgtgaagtactatccaaaaacaaacgccttgtactttgtacgagcaaagagataatgtgttctaaacccctttccttttctgtggcttttaatttggaattttccagtgtgtaagcatttggactgagaattgggaaaacaaaattactcccagaagccaaaactctttaattcccaaccgaagtcactccaggctgggatcaaatctccattaagaaaaaaaattatatataaatatatatatatatattatatagccaactctgttgacaaaaaaagggagagatttccatcctggttcagataaagttgttgctgtgttttaacaggggctgggctgcctttttctaccttgctggtaactagaccaagaagttagagaatagactaacatcagtaacttcccaaaagaaactgaagagccccctgtaaatctttatgtggccttcttggagttaaaaaatgaaagggcatatgtaagttgcaaaggtggagggttttagactctcatgcttcaggtgctgtcggggtaaaagtaactgtttttccccttctcttaaaaccacagaggacctgtgacagctctgcagaaatgccagtgcctggccccctcttgccttttatggctgaggaaagttacccaacaaaggattttattccacatttgtgtgccgggtcattgtgaaataatgtttatgcagccaacatctgaccgcctagtagtgtccattggtctttggagtgcttcttgtgtgtctcagaaaacattttgtgtctgattgtggaaatttctgacaatcaatcatatttggtggcaagttgccaaaaaacatatttattctcctctttcttcccttagaacatggtacttggaaactgccttttccattcacttacaggctgcttttttcttctaccttttttcttttcttttttttttttcatatgtggtgaagtcctaaaacctgtctgactttctgtttcttttacaaagctcaggtgcctacagaaatcagaagctgcttagaaatacttgtggaaccctttccctggtgtcactagggggccagtagggaattctaagatgccaatattgtgagaaatctttgaagcaagcatcaaaagatactgttttttccctatgggcttctttttacttccaaagcacattgagcacactcatcccatatttgtagaatgtggaaattgattctggaagggaattccaataacagttctttttagaaatgtttttttccttgtggtgacatatattcctcttcctggctattggcaggtgatggagttgagaatcatgtacttgacttcttgacgcatggctgacctcagaaacagctccatcctttgcacttgtcttcttcatgtgtcacccaaatagggcttgggtttttactttcacttcatttctgagattaaggtgtaaccaagtagagcatttctttgcttgatacagaaagttactagtctcaaccatggcctgggcataggagatgtcaaaataagtttatttcaaatggcaccatttaaatagggatttttggtgatttctcatcagtggaaagaggatttttgttttgcctttgttttgttttgaaatttaaatcctaatttcaaaacatcaccttgccaccctgacactcctctttttattattagcgtttctcaggcacaaagcctgctgcagctggccctgggtcctggctttcagccagcatctggcagcctaagtgtactgataagtgtgttttctcctgttacatcatgctgaatcctttcccttagccattagcttttatgatgtggtcttcgtaggaaagccaccctggtgccaagcctagcttgtggggaggggtatgtgttccagaaactgctctttgtgttcccttcaatgaggaaacaacatgtgtctacttatgtggcatccaactgcttggagctccacacttccctttcgcgactcaggctctggtgctgttgccaatccttgcttggcaaagactgttcgatcatgtggggtccttatttacaagggaaagctgggccagaaggctagcaattcaggtgttaccgctattgctgtaccttgtgttaggacattgtgtttgtgcatggactgtgcctccaaactcagtagttcctatctaaatataaagtatattagaaacctgaaagtacagaatctcaaccttacagtctttcccttagtcctgtggccttcctaagccagctgttaacgtgttgattccttccacttcccccaagtaggcaggcaacagatatgttgattgtcttagaaagtaatctggttcctctgaactccattgaattccagtttgacgcatactgcctggaaccagactgtttgcttacagctttttaagaaaaatctgccttgtctgcccccattatggttggtcttggtagctcctgggcactgtgggcgtgtaccatgggaaagtgattcaacacagtgaaggtgattgtctcctcaggcctcctgaagccacctgtgcggtgggacttcacgtgtctcggccaaggcgagcatttccacaatgccgtggatgctgcagtcaggccagattgaaccatgaccccatttttcacatgataccaattttgtcttaaaattcactgagaaaaatgagactaaattttttttaaccctcaggagcacctgaagcaaatatttatccgtatttattgaaaattcattttgtttctacttgaagctttaaccccttccattcctgcaagtgtgccttttgagagctcccatggcctagtgacttcactggtcaccttgtccatcttacttaagaattttagtctctccctaccctcttggacagagcttcctgttctcttatttcacaggttatgcagcagagcgggttttgtgttttcattcctatttccacccttcatttggttggtggactccacaacctcaccctaccctacactttgggagcacaaatttggtgttgaaacaagcttaaatttcattttagggcatactgggcttactctcctcccagctgtctgtggattgatttgattttaatgttcgagttttacagcaacagctgaaaaccatgaactattctaggaactgtgttggaactctttaaaataaagaaaagaggaggaggaggaggaagaaagaaaaccaacttaagaagccttgactttggaggacagaaagccaccagccaatggagaacaaagagatgtttccctttcctttctttcaccttgtcattctgggtttccttctgcttcactctttccttcccccttaaaagtggtattcctggttggtctgtctgtctgtccttgtccttgtggtgatcctggcatggtgatatgctccactttgcattatccatggtctcttaccagcgcacaagtcagtggggaggatctaaccacgcctggtggtgaggaagctgaatttccaggcctgcgtcccatgtagcctctccatgaactgcagaaggcatgttctgcatggttaccagtaagtggctccctctcaccgtgttcattgtcaaatgagagcaaactttaggtgttggctccattgtacactctacttgctctgctcccctccctccaaccagggttcatgtcagtgcacaccccatgtgccctggcgaagctggtgctgtgagtgatgtttcccatacaactcagggatgccaggtggcttaccctgagatagtcattttgggcacataacagtgtaggaatgaaacatggatttcattgatatttaaatctgtcaatttcattttttgttaatgttttcccctgatgactttttagcaatttaacaaataaaatggacaattgtcttaactgttttattagcaaaaaaagaa

SEQ ID NO: 307605 - DNA, 6000 bp, Homo sapiens
  misc_feature (25)..(25): n is a, c, g, or t
agcgggtcttctcccggcctgagcngcagcagctgcggcggcggcggcgtttgagtggaggaagatggcggctccgggcggctcggggtcccgccagctgtgaggagccccgagcacggctgtcgcggcctgaggcagagcgcctctgctctggccctgtccctggctccctcattaccgtcgccagcggagcgaacccgagagcgtggagcgggctgggccagagatgggatttcgccatgttgcccacgctggtctcgaactcctgacctaaggtgatctgccggcctcagaatcccaaagtgctgggactacaggtgtgagccactgcacccaaccaagaactactatattttctgttgagtggaatgtcatggccagctcctcggacagtgaagatgacagtttcatggctgtggaccaggaagaaactgtgctggaagggacaatggatcaagatgaggagccccacccagtattggaggctgaggagactagacataataggtccatgtcggagctgccagaagaggttttggagtatatcctgtcctttctctcaccgtatcaggaacacaaaactgcggcccttgtctgcaaacagtggtatcgacttatcaaaggtgtagcccatcagtgttatcatggtttcatgaaggctgtccaggaaggaaacattcagtgggagagccgtacctatccttatcctggaaccccaatcactcagcgcttctcgcacagtgcatgctattatgatgctaatcagtctatgtatgtgtttggaggctgtacccagagcagctgcaatgctgctttcaatgacctctggagacttgacctaaacagcaaagagtggatccgacctttggcttcagggtcctatccttcccccaaagctggagcaactctggtcgtgtacaaggacttgctagtgctgtttggtggctggacgcggccaagcccttatcccctacaccagccagagagattctttgatgaaatacacacttactcaccctctaaaaattggtggaactgcattgtgacaacccatgggccacctcccatggctggccactcctcctgtgtgatagatgataaaatgattgtctttggtggctctttaggatcccggcaaatgagcaatgatgtctgggtccttgaccttgagcagtgggcgtggtccaagccgaacatctctggccccagtcctcatcctcgaggtggccaatctcagattgtcatagatgatgcaactatcttaatcctcggagggtgtggcggtcccaatgctctattcaaggatgcttggttgttgcacatgcattctggtccttgggcctggcagccactcaaggtagaaaatgaagagcatggggccccagaactgtggtgccatccagcttgccgggtgggacagtgtgtggtggtcttcagccaggctcctagtgggagagccccactcagccccagtttgaactctcgcccatcacctatcagtgccactcctccagctctcgttcctgaaacccgagagtaccgctctcagtctccagtaagaagcatggatgaagctccttgtgttaacggccgctggggaacactgagacccagggctcaaaggcagactccttcaggttcccgggaagggagcctttccccagccagaggagacggctctcctatcctcaatggtgggagtttgtctccaggaacggcagctgtgggtggctcttctttggacagtcctgtacaggccatatctccaagtactccatctgctcctgaaggatacgacctgaaaataggactttctttggccccccgacgaggatcactaccagatcagaaagatctgagattaggatccatagtccctaaatgttggcaaacccctataccagagtatgaactgcaagcccatgcagatgtacgtgctggacattaaagacaccaaggagaaggggcgggtcaaatggaaagtatttaatagcagttctgtggttggacctcctgaaaccagcctgcataccgtggtacaaggcaggggtgaactcatcatatttggaggactcatggacaagaaacagaatgtgaagtactatccaaaaacaaacgccttgtactttgtacgagcaaagagataatgtgttctaaacccctttccttttctgtggcttttaatttggaattttccagtgtgtaagcatttggactgagaattgggaaaacaaaattactcccagaagccaaaactctttaattcccaaccgaagtcactccaggctgggatcaaatctccattaagaaaaaaaattatatataaatatatatatatatattatatagccaactctgttgacaaaaaaagggagagatttccatcctggttcagataaagttgttgctgtgttttaacaggggctgggctgcctttttctaccttgctggtaactagaccaagaagttagagaatagactaacatcagtaacttcccaaaagaaactgaagagccccctgtaaatctttatgtggccttcttggagttaaaaaatgaaagggcatatgtaagttgcaaaggtggagggttttagactctcatgcttcaggtgctgtcggggtaaaagtaactgtttttccccttctcttaaaaccacagaggacctgtgacagctctgcagaaatgccagtgcctggccccctcttgccttttatggctgaggaaagttacccaacaaaggattttattccacatttgtgtgccgggtcattgtgaaataatgtttatgcagccaacatctgaccgcctagtagtgtccattggtctttggagtgcttcttgtgtgtctcagaaaacattttgtgtctgattgtggaaatttctgacaatcaatcatatttggtggcaagttgccaaaaaacatatttattctcctctttcttcccttagaacatggtacttggaaactgccttttccattcacttacaggctgcttttttcttctaccttttttcttttcttttttttttttcatatgtggtgaagtcctaaaacctgtctgactttctgtttcttttacaaagctcaggtgcctacagaaatcagaagctgcttagaaatacttgtggaaccctttccctggtgtcactagggggccagtagggaattctaagatgccaatattgtgagaaatctttgaagcaagcatcaaaagatactgttttttccctatgggcttctttttacttccaaagcacattgagcacactcatcccatatttgtagaatgtggaaattgattctggaagggaattccaataacagttctttttagaaatgtttttttccttgtggtgacatatattcctcttcctggctattggcaggtgatggagttgagaatcatgtacttgacttcttgacgcatggctgacctcagaaacagctccatcctttgcacttgtcttcttcatgtgtcacccaaatagggcttgggtttttactttcacttcatttctgagattaaggtgtaaccaagtagagcatttctttgcttgatacagaaagttactagtctcaaccatggcctgggcataggagatgtcaaaataagtttatttcaaatggcaccatttaaatagggatttttggtgatttctcatcagtggaaagaggatttttgttttgcctttgttttgttttgaaatttaaatcctaatttcaaaacatcaccttgccaccctgacactcctctttttattattagcgtttctcaggcacaaagcctgctgcagctggccctgggtcctggctttcagccagcatctggcagcctaagtgtactgataagtgtgttttctcctgttacatcatgctgaatcctttcccttagccattagcttttatgatgtggtcttcgtaggaaagccaccctggtgccaagcctagcttgtggggaggggtatgtgttccagaaactgctctttgtgttcccttcaatgaggaaacaacatgtgtctacttatgtggcatccaactgcttggagctccacacttccctttcgcgactcaggctctggtgctgttgccaatccttgcttggcaaagactgttcgatcatgtggggtccttatttacaagggaaagctgggccagaaggctagcaattcaggtgttaccgctattgctgtaccttgtgttaggacattgtgtttgtgcatggactgtgcctccaaactcagtagttcctatctaaatataaagtatattagaaacctgaaagtacagaatctcaaccttacagtctttcccttagtcctgtggccttcctaagccagctgttaacgtgttgattccttccacttcccccaagtaggcaggcaacagatatgttgattgtcttagaaagtaatctggttcctctgaactccattgaattccagtttgacgcatactgcctggaaccagactgtttgcttacagctttttaagaaaaatctgccttgtctgcccccattatggttggtcttggtagctcctgggcactgtgggcgtgtaccatgggaaagtgattcaacacagtgaaggtgattgtctcctcaggcctcctgaagccacctgtgcggtgggacttcacgtgtctcggccaaggcgagcatttccacaatgccgtggatgctgcagtcaggccagattgaaccatgaccccatttttcacatgataccaattttgtcttaaaattcactgagaaaaatgagactaaattttttttaaccctcaggagcacctgaagcaaatatttatccgtatttattgaaaattcattttgtttctacttgaagctttaaccccttccattcctgcaagtgtgccttttgagagctcccatggcctagtgacttcactggtcaccttgtccatcttacttaagaattttagtctctccctaccctcttggacagagcttcctgttctcttatttcacaggttatgcagcagagcgggttttgtgttttcattcctatttccacccttcatttggttggtggactccacaacctcaccctaccctacactttgggagcacaaatttggtgttgaaacaagcttaaatttcattttagggcatactgggcttactctcctcccagctgtctgtggattgatttgattttaatgttcgagttttacagcaacagctgaaaaccatgaactattctaggaactgtgttggaactctttaaaataaagaaaagaggaggaggaggaggaagaaagaaaaccaacttaagaagccttgactttggaggacagaaagccaccagccaatggagaacaaagagatgtttccctttcctttctttcaccttgtcattctgggtttccttctgcttcactctttccttcccccttaaaagtggtattcctggttggtctgtctgtctgtccttgtccttgtggtgatcctggcatggtgatatgctccactttgcattatccatggtctcttaccagcgcacaagtcagtggggaggatctaaccacgcctggtggtgaggaagctgaatttccaggcctgcgtcccatgtagcctctccatgaactgcagaaggcatgttctgcatggttaccagtaagtggctccctctcaccgtgttcattgtcaaatgagagcaaactttaggtgttggctccattgtacactctacttgctctgctcccctccctccaaccagggttcatgtcagtgcacaccccatgtgccctggcgaagctggtgctgtgagtgatgtttcccatacaactcagggatgccaggtggcttaccctgagatagtcattttgggcacataacagtgtaggaatgaaacatggatttcattgatatttaaatctgtcaatttcattttttgttaatgttttcccctgatgactttttagcaatttaacaaataaaatggacaattgtcttaactgttttattagcaaaaaaagaa

SEQ ID NO: 307606 - DNA, 3316 bp, Homo sapiens
  misc_feature (25)..(25): n is a, c, g, or t
agcgggtcttctcccggcctgagcngcagcagctgcggcggcggcggcgtttgagtggaggaagatggcggctccgggcggctcggggtcccgccagctgtgaggagccccgagcacggctgtcgcggcctgaggcagagcgcctctgctctggccctgtccctggctccctcattaccgtcgccagcggagcgaacccgagagcgtggagcgggctgggccagagatgggatttcgccatgttgcccacgctggtctcgaactcctgacctaaggtgatctgccggcctcagaatcccaaagtgctgggactacaggtgtgagccactgcacccaaccaagaactactatattttctgttgagtggaatgtcatggccagctcctcggacagtgaagatgacagtttcatggctgtggaccaggaagaaactgtgctggaagggacaatggatcaagatgaggagccccacccagtattggaggctgaggagactagacataataggtccatgtcggagctgccagaagaggttttggagtatatcctgtcctttctctcaccgtatcaggaacacaaaactgcggcccttgtctgcaaacagtggtatcgacttatcaaaggtgtagcccatcagtgttatcatggtttcatgaaggctgtccaggaaggaaacattcagtgggagagccgtacctatccttatcctggaaccccaatcactcagcgcttctcgcacagtgcatgctattatgatgctaatcagtctatgtatgtgtttggaggctgtacccagagcagctgcaatgctgctttcaatgacctctggagacttgacctaaacagcaaagagtggatccgacctttggcttcagggtcctatccttcccccaaagctggagcaactctggtcgtgtacaaggacttgctagtgctgtttggtggctggacgcggccaagcccttatcccctacaccagccagagagattctttgatgaaatacacacttactcaccctctaaaaattggtggaactgcattgtgacaacccatgggccacctcccatggctggccactcctcctgtgtgatagatgataaaatgattgtctttggtggctctttaggatcccggcaaatgagcaatgatgtctgggtccttgaccttgagcagtgggcgtggtccaagccgaacatctctggccccagtcctcatcctcgaggtggccaatctcagattgtcatagatgatgcaactatcttaatcctcggagggtgtggcggtcccaatgctctattcaaggatgcttggttgttgcacatgcattctggtccttgggcctggcagccactcaaggtagaaaatgaagagcatggggccccagaactgtggtgccatccagcttgccgggtgggacagtgtgtggtggtcttcagccaggctcctagtgggagagccccactcagccccagtttgaactctcgcccatcacctatcagtgccactcctccagctctcgttcctgaaacccgagagtaccgctctcagtctccagtaagaagcatggatgaagctccttgtgttaacggccgctggggaacactgagacccagggctcaaaggcagactccttcaggttcccgggaagggagcctttccccagccagaggagacggctctcctatcctcaatggtgggagtttgtctccaggaacggcagctgtgggtggctcttctttggacagtcctgtacaggccatatctccaagtactccatctgctcctgaaggatacgacctgaaaataggactttctttggccccccgacgaggatcactaccagatcagaaagatctgagattaggatccatagatctgaattgggatctgaaacccgcttccagtagtaatcccatggatggcatggacaataggacagttgggggaagtatgagacaccctcctgaacagacaaatggtgtgcataccccacctcacgtggccagtgcccttgcaggggccgtctccccaggtgccctgcgtcggagtctggaagccatcaaagcgatgtcctccaaaggcccctcggcctctgcagcactaagtcctcctcttgggtcttctccaggctctcctgggagccagagtttgagcagtggagaaacagtgcccatccctcgcccagggcctgcccaaggagatggacattccttacctcccattgctcgccgcctgggccaccaccctccacagtccctaaatgttggcaaacccctataccagagtatgaactgcaagcccatgcagatgtacgtgctggacattaaagacaccaaggagaaggggcgggtcaaatggaaagtatttaatagcagttctgtggttggacctcctgaaaccagcctgcataccgtggtacaaggcaggggtgaactcatcatatttggaggactcatggacaagaaacagaatgtgaagtactatccaaaaacaaacgccttgtactttgtacgagcaaagagataatgtgttctaaacccctttccttttctgtggcttttaatttggaattttccagtgtgtaagcatttggactgagaattgggaaaacaaaattactcccagaagccaaaactctttaattcccaaccgaagtcactccaggctgggatcaaatctccattaagaaaaaaaattatatataaatatatatatatatattatatagccaactctgttgacaaaaaaagggagagatttccatcctggttcagataaagttgttgctgtgttttaaaaaaaaagaaaagataaaataaaaagaaagaagaaaaaaaaaaaaaaaaaaaaaaaaaaaaaaacacaaaaccggcagggcactctattatgatccgggggggggaaaaaggggcacgaaacgggccaggggcaaagagggatccgggaaccaagtttctgtggtcacacacgcgggaaacactcggggggaccccatataagaggagacgaactaaatgcgagaaaccgcggtataccgtgatagaggcgtggcgaagacaaccgagacgagaggacagaggagggcgggcacagaacaggcggacacccaaaacgaacacagcaaaacggcgagagaaaacagacaagacaaactgagcacgcaaacacacaatcacagcccacaagaagaaaccaaaaggagaagagcacacaaaagaacaaacaggagggagcaacacaaaggaaagcaagagaaacgaaggaggggagaagaagaaacaggacacagacaaccaaggagaggaccgagtgctg

SEQ ID NO: 307607 - DNA, 3027 bp, Homo sapiens
  misc_feature (25)..(25): n is a, c, g, or t
agcgggtcttctcccggcctgagcngcagcagctgcggcggcggcggcgtttgagtggaggaagatggcggctccgggcggctcggggtcccgccagctgtgaggagccccgagcacggctgtcgcggcctgaggcagagcgcctctgctctggccctgtccctggctccctcattaccgtcgccagcggagcgaacccgagagcgtggagcgggctgggccagagatgggatttcgccatgttgcccacgctggtctcgaactcctgacctaaggtgatctgccggcctcagaatcccaaagtgctgggactacaggtgtgagccactgcacccaaccaagaactactatattttctgttgagtggaatgtcatggccagctcctcggacagtgaagatgacagtttcatggctgtggaccaggaagaaactgtgctggaagggacaatggatcaagatgaggagccccacccagtattggaggctgaggagactagacataataggtccatgtcggagctgccagaagaggttttggagtatatcctgtcctttctctcaccgtatcaggaacacaaaactgcggcccttgtctgcaaacagtggtatcgacttatcaaaggtgtagcccatcagtgttatcatggtttcatgaaggctgtccaggaaggaaacattcagtgggagagccgtacctatccttatcctggaaccccaatcactcagcgcttctcgcacagtgcatgctattatgatgctaatcagtctatgtatgtgtttggaggctgtacccagagcagctgcaatgctgctttcaatgacctctggagacttgacctaaacagcaaagagtggatccgacctttggcttcagggtcctatccttcccccaaagctggagcaactctggtcgtgtacaaggacttgctagtgctgtttggtggctggacgcggccaagcccttatcccctacaccagccagagagattctttgatgaaatacacacttactcaccctctaaaaattggtggaactgcattgtgacaacccatgggccacctcccatggctggccactcctcctgtgtgatagatgataaaatgattgtctttggtggctctttaggatcccggcaaatgagcaatgatgtctgggtccttgaccttgagcagtgggcgtggtccaagccgaacatctctggccccagtcctcatcctcgaggtggccaatctcagattgtcatagatgatgcaactatcttaatcctcggagggtgtggcggtcccaatgctctattcaaggatgcttggttgttgcacatgcattctggtccttgggcctggcagccactcaaggtagaaaatgaagagcatggggccccagaactgtggtgccatccagcttgccgggtgggacagtgtgtggtggtcttcagccaggctcctagtgggagagccccactcagccccagtttgaactctcgcccatcacctatcagtgccactcctccagctctcgttcctgaaacccgagagtaccgctctcagtctccagtaagaagcatggatgaagctccttgtgttaacggccgctggggaacactgagacccagggctcaaaggcagactccttcaggttcccgggaagggagcctttccccagccagaggagacggctctcctatcctcaatggtgggagtttgtctccaggaacggcagctgtgggtggctcttctttggacagtcctgtacaggccatatctccaagtactccatctgctcctgaaggatacgacctgaaaataggactttctttggccccccgacgaggatcactaccagatcagaaagatctgagattaggatccatagatctgaattgggatctgaaacccgcttccagtagtaatcccatggatggcatggacaataggacagttgggggaagtatgagacaccctcctgaacagacaaatggtgtgcataccccacctcacgtggccagtgcccttgcaggggccgtctccccaggtgccctgcgtcggagtctggaagccatcaaagcgatgtcctccaaaggcccctcggcctctgcagcactaagtcctcctcttgggtcttctccaggctctcctgggagccagagtttgagcagtggagaaacagtgcccatccctcgcccagggcctgcccaaggagatggacattccttacctcccattgctcgccgcctgggccaccaccctccacagtccctaaatgttggcaaacccctataccagagtatgaactgcaagcccatgcagatgtacgtgctggacattaaagacaccaaggagaaggggcgggtcaaatggaaagtatttaatagcagttctgtggttggacctcctgaaaccagcctgcataccgtggtacaaggcaggggtgaactcatcatatttggaggactcatggacaagaaacagaatgtgaagtactatccaaaaacaaacgccttgtactttgtacgagcaaagagataatgtgttctaaaccccaaaaaaaaaaaaaaaaaaaaaaaaaaaaaaacacaaaaccggcagggcactctattatgatccgggggggggaaaaaggggcacgaaacgggccaggggcaaagagggatccgggaaccaagtttctgtggtcacacacgcgggaaacactcggggggaccccatataagaggagacgaactaaatgcgagaaaccgcggtataccgtgatagaggcgtggcgaagacaaccgagacgagaggacagaggagggcgggcacagaacaggcggacacccaaaacgaacacagcaaaacggcgagagaaaacagacaagacaaactgagcacgcaaacacacaatcacagcccacaagaagaaaccaaaaggagaagagcacacaaaagaacaaacaggagggagcaacacaaaggaaagcaagagaaacgaaggaggggagaagaagaaacaggacacagacaaccaaggagaggaccgagtgctg

SEQ ID NO: 307608 - DNA, 586 bp, Homo sapiens
gcccacaagagatggcgtccaaggagtagcatcgctccccagccatgcttccctgggatttgggcaagcctccctgcacaccaaacatgagcctcagggcgggctggaggagggggtttccggttcttctgcctctcctgggtctgacctcgtcgttgtcattgcccaggtggcatccaaggctctgctgtctgtccacagcatccggacctctcatctgtctacacccattgcttcaggcttggtccctccgccgtcagtaatgtccagcttcactcaggccgctcacctgcgctttacattccaacatctgctgaactcctgcttctccctgcctctaaatggaccccaactgctcctgctcgcctgatggttcctgcgcctgtgccggctcctgcaaatgaaaagagtgcacatgcacctcctgcaagaagagctgctgctcctgctgccctgtgggctgtgccaagtgtgcccagggctgcatctgcaaagggacgtcggacaactgcagctgctgtgcctgatgccaggacagccctgctctcagatgtaaatagagcaaccttataaacctggatttttt

SEQ ID NO: 307609 - DNA, 6387 bp, Homo sapiens
  misc_feature (396)..(396): n is a, c, g, or t
  misc_feature (1591)..(1591): n is a, c, g, or t
  misc_feature (1617)..(1617): n is a, c, g, or t
  misc_feature (1848)..(1848): n is a, c, g, or t
  misc_feature (2331)..(2331): n is a, c, g, or t
  misc_feature (2411)..(2411): n is a, c, g, or t
  misc_feature (3907)..(3907): n is a, c, g, or t
gatgggccagcagcaccccaagccattcactccatggggcccggtaggacaggacaagaaatggcttggggcagggacagaacagccacctgtggaggacgcagccctcgtcagcgaccagggtcacccatcacgggggtgtcccctctggggtccctgttcagagagaagaggcctaaggagcactggggtccagtcccaagacagtctgatgtccagggatacagaggcgcccccaccccctcacagctctgcaggccatgcacgaaggcctgtgtggatgagaaccgtgtgtgttggtaagaggcacagccctcgccctctggggcctcgcctcctctttgaactcagattctgaaagagcccccatcacattcccctgtgcctctgcggccnttccctgcagatcatctgcccagcggccccctccaccccacaggtgaccctcacaaggggccaggaggaacagagccacagccatgcctcctgtggccaggggtcctcctcagtctagacagcacctgcgatgctccacggcacctgtgtccctcctcctgtgcctggtggccaggacccactccctggctcagactgtgggcaagacaggcagcacccctcagggcagccatgtgagtcccatcgcacctgtcactcagccatggactgtccgtctgcccagcacccctccccaccgggggacttcacggctcttagggtcagtgcatatgtgtgcgtgtgcatgtgctcgcacatcctgaagtccccctgggctcagcccttcactggctttgagctcctctgcctgaggactcctgggtggacaagtgggctggccagaggtgaaggcagcagtgactgggggcctcgggagaaggctgtggcccagtgtgacctccacagggcagaaagggcatgcagaggagaggctggacagcggcttgtaggaatgaagtcccaggcagcaaagacaggagtacgaggttgaccagatggctctggggccgggggtgttgaggatttctgtgattttaagtgatcacgtagtgaattatttttacgcttaacaaagccaccgaggtatggaaatccatcctgacagcagaagactaggtgtgtgaattcactttagaagtcactctgtgttggggggtttggaggggcctctgtggagtccacaccttgccccctctgccttctgggctggccccgggcttggaggcagaggccccttggggtcctggtgggatgagccgttgtgtggggagggcctactgtggccacgctgggagagaggctggacgccagctccgcagcaggattgcacctccccctctcctcctggccatgcctgtgctgaggccctgggagggcggtgcctgacctcagagaatgtcgctctaatggtggaatttcaggtactgccacgtagggaagagtctcgtgggaagggcattttccagcctctgtcacaaaatctccaagggaattcagacctcatctagttccatcctcttattttgcagaagaggaggctgagggcccgggagaccaaggctgcccacctgtgggtggcagagcccaggcacccagngcccccagctccctgccccctgctcnttccgcccacccacacacccagcagctggcctctctgcggccagcctgctcgcttgctggacacctcgacagccccaccgccagccgcaggtgcgcgcaagggacccgtcacaagcatcttgccctgtggcctcctgagaagcgagtgagtggaccacagaggtcatttcccagccacgtggccaggcccagcccgaggcaggaccgggctcagggtgggaagcagggctnctcagaggagccaggatggggcggccaagccgacggcctgcggggccgcctccggactcctaacgcggcaggtgtttttactcctgctgtcacttatgtatcagtgtcactcttgcttcatcttatctgtttccttccaggtccagctttaggggcagctgccaggccttaggagcctttgcaatggttttgtattcctgtagacaccagatataaacagatttatatatttgtgtccctcccctgctccccccagttccccagcccgacgcacactctacacgcaggccactctgacctctgaccccgtgttccatgtggcaggagggcccgccccgggccaggccccaggtcatggctgctggctgtctgtggcggaagtccttggttgtttcctctcccctcctcccggctctcaccattctgtccgtctatctcgtcttgtcctcagtttcaaagcaatgtcacgaagggcttcctttncatgcctaaaaggaaacaatatgtttttggaaagaggtggggttggagcgggttctggggcaacttggggccctcggtcntggggcgatcagaggatatctctggattggctggcatcacagccagttgggagcctcccaagcctgggtcacgttggagaatctgccacccaaggcaggcagggccgggctgggatgcgtcggcctgctttggtggagacaccagggcctgcagtgggctgaaccgtattgtttccctttgaggccagtcctggtcctcgtccccatccatagctcatgctttttgatttgcatctttttttgcatggacatgccgagtagtgataagcagggttttctgttcttttgggcgtctctggtcagactcttctctttcagatcccgtgtcacagcattaggttcaggtgtgtcattgccgtgtcctttgagccctaaaaccaagggcatgaccaaggtgtgcagggagatctagccctgtgaggaagcggcacggtggccgcagggcaggaggtaaggacaccctggtctctgtgcctaggtccgtgcaagacagcggccagggcggccgggagaagctggagctcgtcctgtcgaacctgcaggcagacgtcctggagttgctgctggagtttgtctacacgggctccctggtcatcgactcggccaacgccaagacactgctggaggcggccagcaagttccagttccacaccttctgcaaagtctgcgtgtcctttctcgagaagcagctgacggccagcaactgcctgggcgtgctggccatggccgaggccatgcagtgcagcgagctctaccacatggccaaggccttcgcgctgcagatcttccccgaggtggccgcccaggaggagatcctcagcatctccaaggacgacttcatcgcctacgtctccaacgacagcctcaacaccaaggctgaggagctggtgtacgagacagtcatcaagtggatcaagaaggaccccgcgacacgcacacagtacgcggctgagctcctggccgtggtccgcctccccttcatccaccccagctacctgctcaatgtggttgacaatgaagagctgatcaagtcatcagaagcctgccgggacctggtgaacgaggccaaacgctaccatatgctgccccacgcccgccaggagatgcagacgccccgaacccggccgcgcctctctgcaggtgtggctgaggtcatcgtcttggttgggggccgtcagatggtggggatgacccagcgctcgctggtggccgtcacctgctggaacccgcagaacaacaagtggtaccccttggcctcgctgcccttctatgaccgcgagttcttcagtgtagtgagtgcaggggacaacatctacctctcaggtgggatggaatcaggggtgacgctggctgatgtctggtgctacatgtccctgcttgataactggaacctcgtctccagaatgacagtcccccgctgtcggcacaatagcctcgtctacgatgggaagatttacaccctcgggggacttggcgtggcaggcaacgtggaccangtggagaggtacgacaccatcaccaaccaatgggaggcggtggcccctctgcccaaggcagtacactctgctgcagccacagtgtgtggcggcaagatctacgtgtttggtggggtgaacgaggcaggccgagctgccggcgtcctccagtcttacgttcctcagaccaacacgtggagcttcatcgagtccccaatgattgacaacaagtatgcccccgctgtcacgctcaatggcttcgttttcatcctgggcggggcttatgccagagctaccaccatctacgaccctgagaaaggaaacattaaggcgggcccaaacatgaaccactctcgccagttctgcagtgctgtggtgcttgatggcaagatttatgcaactggaggtattgtcagcagtgaagggcccgcgctgggcaacatggaggcctacgagcccacaaccaacacatggaccctcctcccccacatgccctgccctgtgttcagacacggctgcgtcgtgataaagaaatatattcaaagcggctgacatcagcagaaagcccacgataagactgtggacaagtctggtgaggcaagtgccacgcaatgataattttccagcgacaccaacaagaggccaacaaaacacaatcaaggaactcactgcgctcaacatgttgaatattctctacattgaatgtagaaaatcatcctcgcctttggatgaaacggaggcaccgcgcttggagccgcaggaaccacgatcccgccatggggctggctgcctcctgaacaggggcgctcgctctgccaggtgcaatagagtttcacgtatttttcaactgggagagagaagctgttttttccttcctgcagagcaagcttgatccctaaacaaccatagatcagttatcttatgacaacattaggcatcaggctctcttggaataagatcaaagtgtccttatcactttgattcctacttttgttttttaaccgatctacactttcagtggccgacagaaaacgagggacaatactgtgcatcacaaggcctaggaggctgctggtccccactggggctgaagagaagcccagctgcccacgcggagccaggggtggcagctgtgggacagccggggagcagggacagcggtctgtccttcacaggtttttctactgtgtttttgctggagaaggacagtgattgcgctagctttctcttacccggtatgaattatttagatttctgaggcattttcttgataaacaaaaggctatttttaagtactgagaggaggagcaggccacaagagggataatgttgtgggaattcccaaagctctttgtaggtagtgccagaggggggcttttgctctcatttttctatgtgcagaatagaggatctctcctggggtgggcgatgcccccattttatttttagaaaaagtaactcccagacagccccataaaagctgtgcccaaggaagaagagtctgctctagaaggagcccggttctggctcaggacaccggcccagctccctccatgaggtcaagctgaggaccaggccagtgggaagggaaggagggagaattagcgtctataaagcacaggagactatttttgatattcatagctatatattaaggcacctgccacaagagctctcaggatggggacagccttcttagtggagccatggcagcaaggcctgagggcatgagcagaaccactcttcttgtcacatacgaacctgagaaaagggaagccaggagggaggtcacaccatggctcaaaagggaaaggccttcccacttgtccttagcccctcaaacctcacacggtcaacagtttccattccagggcaggagaatgctgccgccactgcgctgttgagttgaagttggtaccaaatacacatttaccacttttatatctgggaagtcaacttgccatcgtttcatgataacaaccatttataagagaaaaagacaggacacgctttccatcgttcagtatttgatgacacaaaattccagttctaatgttgggcatcaacttctagcactacgagtgtggctcccacttggacaagataccgagcttcgttatgcagtttttaatattatttattattttaaaaagtaataagcacaaaactacatacattgtatgtcatttaaagtatttatgtcaaacagggtgcaagtgtgaacccaaggactggagcacaaattcctaactgcctggggcagggctaatgttagcattggtgtgcgtctgcctccaaaggaggttctagttgtcagcgagactcaacacagatgacattgaaattcgtttctctcctcatctatcacactggagcaaaactggctatttctgtgaatgatataaaacagggttctctgtaatggtattgtacatagtatatgtttactgttaagttcttgttatattataataaatatatttatagatctagacttggaa

SEQ ID NO: 307610 - DNA, 4344 bp, Homo sapiens
  misc_feature (1864)..(1864): n is a, c, g, or t
gggcgggggcgatgctgccggagccgccgccgccgccgccgcctcgatgagagccgcgccgcaccgctcatagccgcacaggctgacaggcaggaggaccgacttccctctcccgggcatcctccctgggctgccgggacgggcggcggcggaggaggaggaggaacgaggggagaaggcggagagcaggaacgcgaggaggaggacctggatccgtttcctccggccaggacccgagcggccccagccaccgctacccgccggcgctgtccgctctccatcagccctcctgcgcccacccgcgaccccggtcattggggtgaccccctcactgcctccccacgtggggccccagctcccgctgatgccaggccactactcgctccctcagccgccctctcagccactgagcagcgtggtggtcaacatgcctgcccaggccctgtatgccagccctcagcccctggccgtgtccacactgcccggtgtggggcaggtggcccgcccaggacccaccgctgtgggcaacggccacatggcagggcccctgctgcctccaccgccgccagcccagccgtccgccactctccccagtggtgcccctgccaccaatgggccccccacaaccgactcggcccacgggctgcagatgctgcggaccattggcgtggggaagtatgagttcaccgacccggggcaccccagagaaatgttgaaggaattgaaccagcaacgcagagcgaaagcgtttacagacctgaaaattgttgttgaaggcagagagtttgaagtccaccaaaatgttctagcttcctgcagcttgtatttcaaggacctgattcaaaggtccgtgcaagacagcggccagggcggccgggagaagctggagctcgtcctgtcgaacctgcaggcagacgtcctggagttgctgctggagtttgtctacacgggctccctggtcatcgactcggccaacgccaagacactgctggaggcggccagcaagttccagttccacaccttctgcaaagtctgcgtgtcctttctcgagaagcagctgacggccagcaactgcctgggcgtgctggccatggccgaggccatgcagtgcagcgagctctaccacatggccaaggccttcgcgctgcagatcttccccgaggtggccgcccaggaggagatcctcagcatctccaaggacgacttcatcgcctacgtctccaacgacagcctcaacaccaaggctgaggagctggtgtacgagacagtcatcaagtggatcaagaaggaccccgcgacacgcacacagtacgcggctgagctcctggccgtggtccgcctccccttcatccaccccagctacctgctcaatgtggttgacaatgaagagctgatcaagtcatcagaagcctgccgggacctggtgaacgaggccaaacgctaccatatgctgccccacgcccgccaggagatgcagacgccccgaacccggccgcgcctctctgcaggtgtggctgaggtcatcgtcttggttgggggccgtcagatggtggggatgacccagcgctcgctggtggccgtcacctgctggaacccgcagaacaacaagtggtaccccttggcctcgctgcccttctatgaccgcgagttcttcagtgtagtgagtgcaggggacaacatctacctctcaggtgggatggaatcaggggtgacgctggctgatgtctggtgctacatgtccctgcttgataactggaacctcgtctccagaatgacagtcccccgctgtcggcacaatagcctcgtctacgatgggaagatttacaccctcgggggacttggcgtggcaggcaacgtggaccangtggagaggtacgacaccatcaccaaccaatgggaggcggtggcccctctgcccaaggcagtacactctgctgcagccacagtgtgtggcggcaagatctacgtgtttggtggggtgaacgaggcaggccgagctgccggcgtcctccagtcttacgttcctcagaccaacacgtggagcttcatcgagtccccaatgattgacaacaagtatgcccccgctgtcacgctcaatggcttcgttttcatcctgggcggggcttatgccagagctaccaccatctacgaccctgagaaaggaaacattaaggcgggcccaaacatgaaccactctcgccagttctgcagtgctgtggtgcttgatggcaagatttatgcaactggaggtattgtcagcagtgaagggcccgcgctgggcaacatggaggcctacgagcccacaaccaacacatggaccctcctcccccacatgccctgccctgtgttcagacacggctgcgtcgtgataaagaaatatattcaaagcggctgacatcagcagaaagcccacgataagactgtggacaagtctggtgaggcaagtgccacgcaatgataattttccagcgacaccaacaagaggccaacaaaacacaatcaaggaactcactgcgctcaacatgttgaatattctctacattgaatgtagaaaatcatcctcgcctttggatgaaacggaggcaccgcgcttggagccgcaggaaccacgatcccgccatggggctggctgcctcctgaacaggggcgctcgctctgccaggtgcaatagagtttcacgtatttttcaactgggagagagaagctgttttttccttcctgcagagcaagcttgatccctaaacaaccatagatcagttatcttatgacaacattaggcatcaggctctcttggaataagatcaaagtgtccttatcactttgattcctacttttgttttttaaccgatctacactttcagtggccgacagaaaacgagggacaatactgtgcatcacaaggcctaggaggctgctggtccccactggggctgaagagaagcccagctgcccacgcggagccaggggtggcagctgtgggacagccggggagcagggacagcggtctgtccttcacaggtttttctactgtgtttttgctggagaaggacagtgattgcgctagctttctcttacccggtatgaattatttagatttctgaggcattttcttgataaacaaaaggctatttttaagtactgagaggaggagcaggccacaagagggataatgttgtgggaattcccaaagctctttgtaggtagtgccagaggggggcttttgctctcatttttctatgtgcagaatagaggatctctcctggggtgggcgatgcccccattttatttttagaaaaagtaactcccagacagccccataaaagctgtgcccaaggaagaagagtctgctctagaaggagcccggttctggctcaggacaccggcccagctccctccatgaggtcaagctgaggaccaggccagtgggaagggaaggagggagaattagcgtctataaagcacaggagactatttttgatattcatagctatatattaaggcacctgccacaagagctctcaggatggggacagccttcttagtggagccatggcagcaaggcctgagggcatgagcagaaccactcttcttgtcacatacgaacctgagaaaagggaagccaggagggaggtcacaccatggctcaaaagggaaaggccttcccacttgtccttagcccctcaaacctcacacggtcaacagtttccattccagggcaggagaatgctgccgccactgcgctgttgagttgaagttggtaccaaatacacatttaccacttttatatctgggaagtcaacttgccatcgtttcatgataacaaccatttataagagaaaaagacaggacacgctttccatcgttcagtatttgatgacacaaaattccagttctaatgttgggcatcaacttctagcactacgagtgtggctcccacttggacaagataccgagcttcgttatgcagtttttaatattatttattattttaaaaagtaataagcacaaaactacatacattgtatgtcatttaaagtatttatgtcaaacagggtgcaagtgtgaacccaaggactggagcacaaattcctaactgcctggggcagggctaatgttagcattggtgtgcgtctgcctccaaaggaggttctagttgtcagcgagactcaacacagatgacattgaaattcgtttctctcctcatctatcacactggagcaaaactggctatttctgtgaatgatataaaacagggttctctgtaatggtattgtacatagtatatgtttactgttaagttcttgttatattataataaatatatttatagatctagacttggaa

SEQ ID NO: 307611 - DNA, 2707 bp, Homo sapiens
tgaaaatgtaaccagcagatgacgtttcttccatctcccttgcaggcacagggccatgggtgaccacggtggccgccgggaaccagcccaccctgatcgcacactcctatggagtggcccagcctcccaccttcagcccggctgtgaacgtccaggccccggtcattggggtgaccccctcactgcctccccacgtggggccccagctcccgctgatgccaggccactactcgctccctcagccgccctctcagccactgagcagcgtggtggtcaacatgcctgcccaggccctgtatgccagccctcagcccctggccgtgtccacactgcccggtgtggggcaggtggcccgcccaggacccaccgctgtgggcaacggccacatggcagggcccctgctgcctccaccgccgccagcccagccgtccgccactctccccagtggtgcccctgccaccaatgggccccccacaaccgactcggcccacgggctgcagatgctgcggaccattggcgtggggaagtatgagttcaccgacccggggcaccccagaggtaagtcctgctgccacgtgcctccccacgggcctgcgtctgcacctccctgcgcggtcactgcaacaccaccgggacagggggtgcttcatgccagctccttcactggcctccccaacccagaggctgcagtggagcctccacctgcccaagacaactggcctgagatgggggagggagggggaaggtgtggagggcgggacaaacaaagtgggaaaatgcgccggggtaagaagaggaaggaagggagagcctgcaaagcccagagcccgtccccctccagcccaagccctggccattctcacctccaacccccaaggccaggccaagctgcaaaagggtgagagtcatccactcctcttagggcaccgcagcagaacagtccctttgggggccttctccacattccatccatgaggacattcagagcatgtactgtgtccttcccagggaaggcactctctgtcgtgccatcggatgagagcactgtccacggcaaacagtctggcccaacggggtgtctacatctcttttgaaagaggacactagacggtcccagaaagtatgcatctctgggcacaacttcccagccttcccacataaaaccccttgagatggcatttcggggtgctctgcctttcggcagagcaaggaaccccactagccactctcctgtcttctctcccaagtctcttcctttgtcatttcaagcaattttcatgccttgtcaagcatcccaacaataaagctcatgtctggatctctgttgggtttaattcccaatctgactgagccctgactgcctttgttttggaaatcagcactagttttaaatgacaaaattgtagaaaattacatctaaattctggtaaactcttgctttaagatctttttttaaaaaatgactaaattgatttttttctttgcattgttttggttaagctctgtctccctttaaaaaaaaaaaaaaaaaagaaagaaagaaacttactcccagttcaagttcatgagttaccaactctgacaactgggcagcgggcatcctacttccaaggctatgccaaagcccaaggcaccgggtggcatattctgtccccacatagcccctctgggctaatgcaagatcttgctggcttgccacgttccaggcacgcatctaggaaaaggagctgttttgtgcaaaaaggtaactagctgagataggactggagtccctagtttggggctcagcaccaagctgggatctgccccaccaaagctgctgggtgcaggcagctaaacattgtcagccctgagcccatgagatcagaaagacacaggtggcggggacaggaccctgcaggacttctgtgcccactgggtcaatgaccattgcagagctgttcctgtaacctctgtgcaaggacctgagggtgtgaaccatcctctgtggtggtcctgagccaatggaagggaggggacaagaaataggggccctgctaagattccctctaccaggccccactgggcagaccgagggccaggtgtgagggccagggatggggtgggcctagaaagtgtcctcagccctgccttctggtgagccagcgggacccaccagctctagccagtgacaacaactgaccggtccatcaccctgatttccagaggttgccagcacactggctctttcctcgaaattccatgtaactcgcttctctatttacggcctcatcagctgatggagccccttatatttgcagggaagaaagagtgacgcacgcgcctacaaatgcctccaaactcaagcctgggtgggttttttctttttttaatatataagtaatttctcttttcatttctaatcttaaaagcctttattgctgaagctataatttgtctgtcagatctaatgtcaaacaactgcatattttttaaaataagaaacccgaattttgaaactaaatctttgaaacttgccatgtgagagtcgtgttcctgacaggaccacgtgggcttggatctgggtcacttttaattttgcccctagggattttacatctctgaagcccaattgatttcacactcctaaatgacagacagctggctccaggcaggaacaggaggctctgcgtgatggcgtcaacacaagtcagaactccactttaga

SEQ ID NO: 307612 - DNA, 496 bp, Homo sapiens
gggcgggggcgatgctgccggagccgccgccgccgccgccgcctcgatgagagccgcgccgcaccgctcatagccgcacaggctgacaggcaggaggaccgacttccctctcccgggcatcctccctgggctgccgggacgggcggcggcggaggaggaggaggaacgaggggagaaggcggagagcaggaacgcgaggaggaggacctggatccgtttcctccggccaggacccgagcggccccagccaccgctacccgccggcgctgtccgctctccatcagccctcctgcgcccacccgcgaccccgggctctctgcgcgtcgggccggggccggagccgcgcgccggagactatctggcttcctggtgatgctcacgctttgctaagtgttggcggccatcgtggttttcgcatcctggggacgaatcctgagcttgccagagacgggcggcgcaaggtccgggctctgtttccctgtgagaagccgcctcg

SEQ ID NO: 307613 - DNA, 3304 bp, Homo sapiens
  misc_feature (1867)..(1867): n is a, c, g, or t
  misc_feature (2122)..(2122): n is a, c, g, or t
  misc_feature (2675)..(2675): n is a, c, g, or t
cagcgaggccatcaccagcctcgtggccagctctgcgtctgcggtcaccaccaaggctcccggcatctccaaaggggacagtcagtcccagggactggcgaccagcatccggtgggggcagacgcctatcaatcagtccacaccctgggacactgatgagccaccctccaaacagatgagagagagtgacaatccaggcacagggccatgggtgaccacggtggccgccgggaaccagcccaccctgatcgcacactcctatggagtggcccagcctcccaccttcagcccggctgtgaacgtccaggccccggtcattggggtgaccccctcactgcctccccacgtggggccccagctcccgctgatgccaggccactactcgctccctcagccgccctctcagccactgagcagcgtggtggtcaacatgcctgcccaggccctgtatgccagccctcagcccctggccgtgtccacactgcccggtgtggggcaggtggcccgcccaggacccaccgctgtgggcaacggccacatggcagggcccctgctgcctccaccgccgccagcccagccgtccgccactctccccagtggtgcccctgccaccaatgggccccccacaaccgactcggcccacgggctgcagatgctgcggaccattggcgtggggaagtatgagttcaccgacccggggcaccccagagaaatgttgaaggaattgaaccagcaacgcagagcgaaagcgtttacagacctgaaaattgttgttgaaggcagagagtttgaagtccaccaaaatgttctagcttcctgcagcttgtatttcaaggacctgattcaaaggtccgtgcaagacagcggccagggcggccgggagaagctggagctcgtcctgtcgaacctgcaggcagacgtcctggagttgctgctggagtttgtctacacgggctccctggtcatcgactcggccaacgccaagacactgctggaggcggccagcaagttccagttccacaccttctgcaaagtctgcgtgtcctttctcgagaagcagctgacggccagcaactgcctgggcgtgctggccatggccgaggccatgcagtgcagcgagctctaccacatggccaaggccttcgcgctgcagatcttccccgaggtggccgcccaggaggagatcctcagcatctccaaggacgacttcatcgcctacgtctccaacgacagcctcaacaccaaggctgaggagctggtgtacgagacagtcatcaagtggatcaagaaggaccccgcgacacgcacacagtacgcggctgagctcctggccgtggtccgcctccccttcatccaccccagctacctgctcaatgtggttgacaatgaagagctgatcaagtcatcagaagcctgccgggacctggtgaacgaggccaaacgctaccatatgctgccccacgcccgccaggagatgcagacgccccgaacccggccgcgcctctctgcaggtgtggctgaggtcatcgtcttggttgggggccgtcagatggtggggatgacccagcgctcgctggtggccgtcacctgctggaacccgcagaacaacaagtggtaccccttggcctcgctgcccttctatgaccgcgagttcttcagtgtagtgagtgcaggggacaacatctacctctcaggtgggatggaatcaggggtgacgctggctgatgtctggtgctacatgtccctgcttgataactggaacctcgtctccagaatgacagtcccccgctgtcggcacaatagcctcgtctacgatgggaagatttacaccctcgggggacttggcgtggcaggcaacgtggaccangtggagaggtaatgaggccacggtcaggacaggggcatgctctttgctcaccaagaactgaaatcacgtcactcactgtacctcccaacacccactcagtggcgatggagcagagcctggaccattcatatgggcagtcatcccaggctcttcagtcacagcaccgggggcagcagggtgtgggatacaagcagatgggatgacatctgtgtcacctttgcagtcgctgagatgggagatggggcgcttctgtcncgacaacccatttaggtgtcagacaagctggaggcccaagatccagttgcagaaggcctgggatgagccagaccctcctggccaggcagtcagggaacaccctgcaccatgagcaccagcccagagactgctggggtttcgggcaaagctggaagcaatgtttaaaatgcaggtcatgccagtggcggtgcctccttgtcctgccaagcggggggtcccacaccagggagctcccttcctccctccagccacacacaccaggacatctgttcgtaatacagagaaaggccactgcatacaaactaagcaatttagggagaacattcttgccaaccctctagaactttccagaagaaaaaataagccaaaggaccacgtgtgaacctgccctccgctgggagtcccagcctggcttcctcccaaggccattgtggagggtcagatacaggcatgaggggcgtgggctgaagtgggtgcttccggatgagaatacaaaatccttttcccttgagccagggagactgttctttcttacagagaacagatgcctggnggaaaagctcaggaagctttgtcaggcagcagaacggaggcttagtcctgcttttggagaaactagtgcctggagggtaacccgtcaggctgacctggcccaaagcacaacccaggggagacagctaagattgccagagcccctcctgcacctgagcccaccacccccaccgccatgtgtcaccagaaagcacatcttcccgtgggacatcatgttgcctatgaagccacacatacccctcaatttgtatttttcccccttggtggctaattggacacttgacaaatgttacagcaaagacggttgcagagtgaggcaggctctgaatgctcattgtgggcttttaactcctcccccaagtagagcccagagatggctcagtaacaacatttagttatcatattgatctggcaatcatgggcattcccacgtgaaaatgaggatattagcgcagttgctggagctgggttggccccggtgctggcagccttcagtgtgacccactgcccagctatgcataccccaagcattctggaagcatcggcttccgatcatttgtcatccaataataaacaaacacatgaaaaatgagacattttctctgtaggagtaaactgaactggatccgt

SEQ ID NO: 307614 - DNA, 2723 bp, Homo sapiens
tctgcacagacgctgccataggcagaaagagcccactgatgttccagaggaaggccgagagggctagtttggacgagaccccaggaggtcttgagtgtctcatcgcagtgccccccactgctggtgtgatctcaggctatgctggccatgctgagggcgaggagcagatggcagtttgctgcccttgcttgtgacctctgccccgcacaaggtccatcttgaccctgggctctttttctcctctcctgcaggtacgacaccatcaccaaccaatgggaggcggtggcccctctgcccaaggcagtacactctgctgcagccacagtgtgtggcggcaagatctacgtgtttggtggggtgaacgaggcaggccgagctgccggcgtcctccagtcttacgttcctcagaccaacacgtggagcttcatcgagtccccaatgattgacaacaagtatgcccccgctgtcacgctcaatggcttcgttttcatcctgggcggggcttatgccagagctaccaccatctacgaccctgagaaaggaaacattaaggcgggcccaaacatgaaccactctcgccagttctgcagtgctgtggtgcttgatggcaagatttatgcaactggaggtattgtcagcagtgaagggcccgcgctgggcaacatggaggcctacgagcccacaaccaacacatggaccctcctcccccacatgccctgccctgtgttcagacacggctgcgtcgtgataaagaaatatattcaaagcggctgacatcagcagaaagcccacgataagactgtggacaagtctggtgaggcaagtgccacgcaatgataattttccagcgacaccaacaagaggccaacaaaacacaatcaaggaactcactgcgctcaacatgttgaatattctctacattgaatgtagaaaatcatcctcgcctttggatgaaacggaggcaccgcgcttggagccgcaggaaccacgatcccgccatggggctggctgcctcctgaacaggggcgctcgctctgccaggtgcaatagagtttcacgtatttttcaactgggagagagaagctgttttttccttcctgcagagcaagcttgatccctaaacaaccatagatcagttatcttatgacaacattaggcatcaggctctcttggaataagatcaaagtgtccttatcactttgattcctacttttgttttttaaccgatctacactttcagtggccgacagaaaacgagggacaatactgtgcatcacaaggcctaggaggctgctggtccccactggggctgaagagaagcccagctgcccacgcggagccaggggtggcagctgtgggacagccggggagcagggacagcggtctgtccttcacaggtttttctactgtgtttttgctggagaaggacagtgattgcgctagctttctcttacccggtatgaattatttagatttctgaggcattttcttgataaacaaaaggctatttttaagtactgagaggaggagcaggccacaagagggataatgttgtgggaattcccaaagctctttgtaggtagtgccagaggggggcttttgctctcatttttctatgtgcagaatagaggatctctcctggggtgggcgatgcccccattttatttttagaaaaagtaactcccagacagccccataaaagctgtgcccaaggaagaagagtctgctctagaaggagcccggttctggctcaggacaccggcccagctccctccatgaggtcaagctgaggaccaggccagtgggaagggaaggagggagaattagcgtctataaagcacaggagactatttttgatattcatagctatatattaaggcacctgccacaagagctctcaggatggggacagccttcttagtggagccatggcagcaaggcctgagggcatgagcagaaccactcttcttgtcacatacgaacctgagaaaagggaagccaggagggaggtcacaccatggctcaaaagggaaaggccttcccacttgtccttagcccctcaaacctcacacggtcaacagtttccattccagggcaggagaatgctgccgccactgcgctgttgagttgaagttggtaccaaatacacatttaccacttttatatctgggaagtcaacttgccatcgtttcatgataacaaccatttataagagaaaaagacaggacacgctttccatcgttcagtatttgatgacacaaaattccagttctaatgttgggcatcaacttctagcactacgagtgtggctcccacttggacaagataccgagcttcgttatgcagtttttaatattatttattattttaaaaagtaataagcacaaaactacatacattgtatgtcatttaaagtatttatgtcaaacagggtgcaagtgtgaacccaaggactggagcacaaattcctaactgcctggggcagggctaatgttagcattggtgtgcgtctgcctccaaaggaggttctagttgtcagcgagactcaacacagatgacattgaaattcgtttctctcctcatctatcacactggagcaaaactggctatttctgtgaatgatataaaacagggttctctgtaatggtattgtacatagtatatgtttactgttaagttcttgttatattataataaatatatttatagatctagacttggaa

SEQ ID NO: 307615 - DNA, 1117 bp, Homo sapiens
cagcgaggccatcaccagcctcgtggccagctctgcgtctgcggtcaccaccaaggctcccggcatctccaaaggggacagtcagtcccagggactggcgaccagcatccggtgggggcagacgcctatcaatcagtccacaccctgggacactgatgagccaccctccaaacagatgagagagagtgacaatccaggcacagggccatgggtgaccacggtggccgccgggaaccagcccaccctgatcgcacactcctatggagtggcccagcctcccaccttcagcccggctgtgaacgtccaggccccggtcattggggtgaccccctcactgcctccccacgtggggccccagctcccgctgatgccaggccactactcgctccctcagccgccctctcagccactgagcagcgtggtggtcaacatgcctgcccaggccctgtatgccagccctcagcccctggccgtgtccacactgcccggtgtggggcaggtggcccgcccaggacccaccgctgtgggcaacggccacatggcagggcccctgctgcctccaccgccgccagcccagccgtccgccactctccccagtggtgcccctgccaccaatgggccccccacaaccgactcggcccacgggctgcagatgctgcggaccattggcgtggggaagtatgagttcaccgacccggggcaccccagagaaatgttgaaggaattgaaccagcaacgcagagcgaaagcgtttacagacctgaaaattgttgttgaaggcagagagtttgaagtccaccaaaatgttctagcttcctgcagcttgtatttcaaggacctgattcaaaggtccgtgcaagacagcggccagggcggccgggagaagctggagctcgtcctgtcgaacctgcaggcagacgtcctggagttgctgctggagtttgtctacacgggctccctggtcatcgactcggccaacgccaagacactgctggaggcggccagcaagttccagttccacaccttctgcaaagtctgcgtgtcctttctcggtgagcccgggggccacatatgtcgcttggggggaagagtgcagatgggcggcgttggatgcagt

SEQ ID NO: 307616 - DNA, 510 bp, Homo sapiens
aggtgggttgcagaggcaggctgcatcccggaatcatgttgtcccactgcctattaatagaacaagtgaagggcagaatgctggaacacaccagacatagagggagggaggtcctgccagatgtgtctacacaactgtctacatagcatgacagtagcagtggattcgggacccacctgtacatgtttccaaagctccttcctgcacactcgggacctcagctccaaggcgtgactcatttctcagtctcaccatcctttgttggctcagacatcgcatgcctctgccccactggggttgtgtgcctgcgtctctcacttctttgaggttggggaaagcctagtccagaaaatgaaaacccatagaccagcctaacttcctttcaaccaagtgacggcctcctggttcctctcagttcatcatcaaaatcagtgtgtacatgtcatacaagccaagagtgttcatgtcctcgttcctttcaaatgaaggtgatatatactttttcactga

SEQ ID NO: 307617 - DNA, 2411 bp, Homo sapiens
aggtgggttgcagaggcaggctgcatcccggaatcatgttgtcccactgcctattaatagaacaagtgaagggcagaatgctggaacacaccagacatagagggagggaggtcctgccagatgtgtctacacaactgtctacatagcatgacagtagcagtggattcgggacccacctgtacatgtttccaaagctccttcctgcacactcgggacctcagctccaaggcgtgactcatttctcagtctcaccatcctttgttggctcagacatcgcatgcctctgccccactggggttgtgtgcctgcgtctctcacttctttgaggttggggaaagcctagtccagaaaatgaaaacccatagaccagcctaacttcctttcaaccaagtgacggcctcctggttcctctcagttcatcatcaaaatcagtgtgtacatgtcatacaagccaagagtgttcatgtcctcgttcctttcaaatgaaggtgatatatactttttcactgagtttttattcctgaaattctttcttctggagcaggaagcaaatgtcctggaatcgtagacttttacagtcagaagggtcattcacgttcatctagtgcccctctcactctgcagggatcctcctgcctctcctctgcccctgtccagtgcctggtggtccagcctgtgatgggcaggcctaggctgccatccgcaggctctgtagttctgctttctattgaaccaagatgtttctacgttgcctattggtcgtggttctgtccagagcagttcaggctggggctgttcacttgcccctccttgaggcagacctttagatattttcagttttcatcacatgtctaacaccacttccaccccacccctcacctcttaggctaaatccaagctaaatcccccaatgtcttttttttttttttttttttgagacgagtctcatctgtcacccaggctggagtgcaatggcatggtctcggctcactgcaacctccgcctcctgggttcaagctattctgcctcagcctcccaaggagccaggactacaggtgcatgccaccacgcccggctaatttttgtattttttagtagagacagggtttcacccagccattgagacaagctggtttcaaactcctgaccttgtggtccgcccgccccggcctcccagagtgctgggattacaggcgtgagccaccgcgcccatctcccctgcaatgtctttagttagaccttttccaccatcatgtctaactgggctacggtttggggaaagtgtccaaattagtccgtgttatcctaaaaggggtgtgccccggattagcagggccagggctagggtgagacaaatgaggcacctggggcatacatttaagttggtgcttgcttgcaggtgccaagagagtgctccttgggtttacccccgtggtgcctcctttacctcattctggccccagccctggggttagagtcgcaccagtgtggtccaagtggcataattatctccctaaatgcttgggcagcatcagctttcagtagctgtgccccatgggaggcacattaagctagtggcaagttgagactgcagacctcagcttaatatcagttgttgcccaagacagatctcaccccacatcttcatgacaggcctaacaacaaggcactttgcccttaatcctctactactgcctgctcttcattttgggccaactgtacagctcattttgagatagtagctgatcatttttctgatcagttaactttgtcttattaagcaaaatggagaatataatgttgggaaataagtgtgttgattaaaagaaagtatccccttctaccatcttccatttgtgtctgggttgtgctgggtaaagttctagacttactaacgcagacttcattttggtccggtttccacagcatgcctcgggcatcagtgtccaggagtagctgtatttgaggtttccttcactctggtaggttcctgattcctgatgaaaataacttgaaaaaaaaataattatactactgatcctcttttgggataatgaaattgcgaaggaatgttgttgattataacttttattttttaatgtacagatgtactgtctctcattgagcactgatagaatttatttttctttcaatagtttaaaatcacttatgtggagacacatacttaagtgtgttcaactcgttttcttcccacatatctagtgtgacctttaaaaaccacaactttattttggacattaaatgtgcaatattcactacttattcattgttccacatttttcatacttgtacaaagggtaagtttttatataatggtgagaaacaggaagaaatgacaactggttaagtaaaattctgcaaataaactagattcgaatttaatttaaaca

SEQ ID NO: 307618 - DNA, 2014 bp, Homo sapiens
aggtgggttgcagaggcaggctgcatcccggaatcatgttgtcccactgcctattaatagaacaagtgaagggcagaatgctggaacacaccagacatagagggagggaggtcctgccagatgtgtctacacaactgtctacatagcatgacagtagcagtggattcgggacccacctgtacatgtttccaaagctccttcctgcacactcgggacctcagctccaaggcgtgactcatttctcagtctcaccatcctttgttggctcagacatcgcatgcctctgccccactggggttgtgtgcctgcgtctctcacttctttgaggttggggaaagcctagtccagaaaatgaaaacccatagaccagcctaacttcctttcaaccaagtgacggcctcctggttcctctcagttcatcatcaaaatcagtgtgtacatgtcatacaagccaagagtgttcatgtcctcgttcctttcaaatgaaggtgatatatactttttcactgagtttttattcctgaaattctttcttctggagcaggaagcaaatgtcctggaatcgtagacttttacagtcagaagggtcattcacgttcatctagtgcccctctcactctgcagggatcctcctgcctctcctctgcccctgtccagtgcctggtggtccagcctgtgatgggcaggcctaggctgccatccgcaggctctgtagttctgctttctattgaaccaagatgtttctacgttgcctattggtcgtggttctgtccagagcagttcaggctggggctgttcacttgcccctccttgaggcagacctttagatattttcagttttcatcacatgtctaacaccacttccaccccacccctcacctcttaggctaaatccaagctaaatcccccaatgtcttttttttttttttttttttgagacgagtctcatctgtcacccaggctggagtgcaatggcatggtctcggctcactgcaacctccgcctcctgggttcaagctattctgcctcagcctcccaaggagccaggactacaggtgcatgccaccacgcccggctaatttttgtattttttagtagagacagggtttcacccagccattgagacaagctggtttcaaactcctgaccttgtggtccgcccgccccggcctcccagagtgctgggattacaggcgtgagccaccgcgcccatctcccctgcaatgtctttagttagaccttttccaccatcatgtctaactgggctacggtttggggaaagtgtccaaattagtccgtgttatcctaaaaggggtgtgccccggattagcagggccagggctagggtgagacaaatgaggcacctggggcatacatttaagttggtgcttgcttgcaggtgccaagagagtgctccttgggtttacccccgtggtgcctcctttacctcattctggccccagccctggggttagagtcgcaccagtgtggtccaagtggcataattatctccctaaatgcttgggcagcatcagctttcagtagctgtgccccatgggaggcacattaagctagtggcaagttgagactgcagacctcagcttaatatcagttgttgcccaagacagatctcaccccacatcttcatgacaggcctaacaacaaggcactttgcccttaatcctctactactgcctgctcttcattttgggccaactgtacagctcattttgagatagtagctgatcatttttctgatcagttaactttgtcttattaagcaaaatggagaatataatgttgggaaataagtgtgttgattaaaagaaagtatccccttctaccatcttccatttgtgtctgggttgtgctgggtaaagccaccccctcccctccctttctcccatgcccccagggttgggccagttttgggtggggcagagggtcccagattggctcacactgagaatgtaagaactacaaacagaatttcaattaaattaaattttgtgtc

SEQ ID NO: 307619 - DNA, 1483 bp, Homo sapiens
  misc_feature (518)..(518): n is a, c, g, or t
gggcgtcttcggctcccaccccggggcgtgggcctgggggtccctcttcactgcgcagccacctctagcccgccgctttcgggactctcagccttcttttcccttccctgagggccggccggcaccacaacggggccaaaggcagtaactcggttgaaaggcgcgccctgggacaggtcagcgggctccgccatgcgcggcacgcatcccgcaggagcgggtgccagagcagggtaggccgggagttagcagcccagccaggccgctggactcgggctaggggcggggccagcgcagggggcgcaggcgcacaccgcctccgcggcagcatggcggacgcagctcctcaactaggcaagaggaagcgcgaattggacgtggaggaggcccacgccgccagcacagaggaaaaggaggcaggagttggaaatggtacctgtgctcctgtccgcttaccgttctccggcttcagactgcagaaggtgctgagggagtctgcgcgggacaaaatcattttnctacacgggaaggtgaatgaggcctctggggatggggatggagaggatgccgttgtgatcctggagaagacgccatttcaggtggaacaggtggctcagctcctgacgggcagccctgagctccaattgcagttctccaatgatatctacagcacctatcacttgttccctccaagacaactgaatgatgtaaagacgaccgtggtttaccctgccacagagaaacacctgcagaagtacctgcgccaggacctccgcctgatccgagagacgggagatgactacaggaatattactttaccccacctggagtcccagagcctcagcatccagtgggtgtataacattctcgacaagaaggctgaagcggaccggattgttttcgagaacccagatccctctgatggttttgtcctcatccctgacctcaagtggaaccaacagcagctcgatgacttgtacttgatcgccatctgccatcgccggggcatcagatccctacgcgaccttactccggagcacttgccgctgctcaggaacatcctccaccaggggcaggaggccatcctgcagcgctaccggatgaagggagaccatctgcgagtatacctgcactacctgccctcctactaccacctgcatgtgcacttcaccgccctgggcttcgaggcccccggctcaggcgtggagcgggcccacctgctggctgaggtgatcgagaacttggagtgtgaccctaggcactaccagcagcgcacgctcaccttcgccctcagggctgacgaccccctgctcaagctcttgcaggaggctcagcaaagctgaattaactcaggcagaagagcacagatgtgtgggattgggggaggagtggggacaagattttttatctccaagtgaattttctaaaaatgtattttataccggcttattcctagtattgaataaactagcgggctcactca

SEQ ID NO: 307620 - DNA, 678 bp, Homo sapiens
gttaaataagttgaagcgtcgatactaaaaaaatttcgcgtgctcgtgggtgtataacattctcgacaagaaggctgaagcggaccggattgttttcgagaacccagatccctctgatggttttgtcctcatccctgacctcaagtggaaccaacagcagctcgatgacttgtacttgatcgccatctgccatcgccggggcatcagatccctacgcgaccttactccggagcacttgccgctgctcaggaacatcctccaccaggggcaggaggccatcctgcagcgctaccggatgaagggagaccatctgcgagtatacctgcactacctgccctcctactaccacctgcatgtgcacttcaccgccctgggcttcgaggcccccggctcaggcgtggagcgggcccacctgctggctgaggtgatcgagaacttggagtgtgaccctaggcactaccagcagcgcacgctcaccttcgccctcagggctgacgaccccctgctcaagctcttgcaggaggctcagcaaagctgaattaactcaggcagaagagcacagatgtgtgggattgggggaggagtggggacaagattttttatctccaagtgaattttctaaaaatgtattttataccggcttattcctagtattgaataaactagcgggctcactca

SEQ ID NO: 307621 - DNA, 680 bp, Homo sapiens
gagaggggggtagggggttatatattgtcccaaccagcagcggcgtcgtgggtgtataacattctcgacaagaaggctgaagcggaccggattgttttcgagaacccagatccctctgatggttttgtcctcatccctgacctcaagtggaaccaacagcagctcgatgacttgtacttgatcgccatctgccatcgccggggcatcagatccctacgcgaccttactccggagcacttgccgctgctcaggaacatcctccaccaggggcaggaggccatcctgcagcgctaccggatgaagggagaccatctgcgagtatacctgcactacctgccctcctactaccacctgcatgtgcacttcaccgccctgggcttcgaggcccccggctcaggcgtggagcgggcccacctgctggctgaggtgatcgagaacttggagtgtgaccctaggcactaccagcagcgcacgctcaccttcgccctcagggctgacgaccccctgctcaagctcttgcaggaggctcagcaaagctgaattaactcaggcagaagagcacagatgtgtgggattgggggaggagtggggacaagattttttatctccaagtgaattttctaaaaatgtattttataccggcttattcctagtattgaataaactagcgggctcactca

SEQ ID NO: 307622 - DNA, 495 bp, Homo sapiens
cggacgcgtgggtctatcaccctatagattgggcgaccttactccggagcacttgccgctgctcaggaacatcctccaccaggggcaggaggccatcctgcagcgctaccggatgaagggagaccatctgcgagtatacctgcactacctgccctcctactaccacctgcatgtgcacttcaccgccctgggcttcgaggcccccggctcaggcgtggagcgggcccacctgctggctgaggtgatcgagaacttggagtgtgaccctaggcactaccagcagcgcacgctcaccttcgccctcagggctgacgaccccctgctcaagctcttgcaggaggctcagcaaagctgaattaactcaggcagaagagcacagatgtgtgggattgggggaggagtggggacaagattttttatctccaagtgaattttctaaaaatgtattttataccggcttattcctagtattgaataaactagcgggctcactca

SEQ ID NO: 307623 - DNA, 1178 bp, Homo sapiens
  misc_feature (213)..(213): n is a, c, g, or t
tatacaggctaggtagcgaggcctgggttgcgcgcagctcctcaactaggcaagaggaagcgcgaattggacgtggaggaggcccacgccgccagcacagaggaaaaggaggcaggagttggaaatggtacctgtgctcctgtccgcttaccgttctccggcttcagactgcagaaggtgctgagggagtctgcgcgggacaaaatcattttnctacacgggaaggtgaatgaggcctctggggatggggatggagaggatgccgttgtgatcctggagaagacgccatttcaggtggaacaggtggctcagctcctgacgggcagccctgagctccaattgcagttctccaatgatatctacagcacctatcacttgttccctccaagacaactgaatgatgtaaagacgaccgtggtttaccctgccacagagaaacacctgcagaagtacctgcgccaggacctccgcctgatccgagagacgggagatgactacaggaatattactttaccccacctggagtcccagagcctcagcatccagtgggtgtataacattctcgacaagaaggctgaagcggaccggattgttttcgagaacccagatccctctgatggttttgtcctcatccctgacctcaagtggaaccaacagcagctcgatgacttgtacttgatcgccatctgccatcgccggggcatcagatccctacgcgaccttactccggagcacttgccgctgctcaggaacatcctccaccaggggcaggaggccatcctgcagcgctaccggatgaagggagaccatctgcgagtatacctgcactacctgccctcctactaccacctgcatgtgcacttcaccgccctgggcttcgaggcccccggctcaggcgtggagcgggcccacctgctggctgaggtgatcgagaacttggagtgtgaccctaggcactaccagcagcgcacgctcaccttcgccctcagggctgacgaccccctgctcaagctcttgcaggaggctcagcaaagctgaattaactcaggcagaagagcacagatgtgtgggattgggggaggagtggggacaagattttttatctccaagtgaattttctaaaaatgtattttataccggcttattcctagtattgaataaactagcgggctcactca

SEQ ID NO: 307624 - DNA, 1130 bp, Homo sapiens
tatacaggctaggtagcgaggcctgggttgcgcgcagctcctcaactaggcaagaggaagcgcgaattggacgtggaggaggcccacgccgccagcacagaggaaaaggaggcaggagttggaaatggtacctgtgctcctgtccgcttaccgttctccggcttcagactgcagaaggtgaatgaggcctctggggatggggatggagaggatgccgttgtgatcctggagaagacgccatttcaggtggaacaggtggctcagctcctgacgggcagccctgagctccaattgcagttctccaatgatatctacagcacctatcacttgttccctccaagacaactgaatgatgtaaagacgaccgtggtttaccctgccacagagaaacacctgcagaagtacctgcgccaggacctccgcctgatccgagagacgggagatgactacaggaatattactttaccccacctggagtcccagagcctcagcatccagtgggtgtataacattctcgacaagaaggctgaagcggaccggattgttttcgagaacccagatccctctgatggttttgtcctcatccctgacctcaagtggaaccaacagcagctcgatgacttgtacttgatcgccatctgccatcgccggggcatcagatccctacgcgaccttactccggagcacttgccgctgctcaggaacatcctccaccaggggcaggaggccatcctgcagcgctaccggatgaagggagaccatctgcgagtatacctgcactacctgccctcctactaccacctgcatgtgcacttcaccgccctgggcttcgaggcccccggctcaggcgtggagcgggcccacctgctggctgaggtgatcgagaacttggagtgtgaccctaggcactaccagcagcgcacgctcaccttcgccctcagggctgacgaccccctgctcaagctcttgcaggaggctcagcaaagctgaattaactcaggcagaagagcacagatgtgtgggattgggggaggagtggggacaagattttttatctccaagtgaattttctaaaaatgtattttataccggcttattcctagtattgaataaactagcgggctcactca

SEQ ID NO: 307625 - DNA, 1726 bp, Homo sapiens
  misc_feature (518)..(518): n is a, c, g, or t
gggcgtcttcggctcccaccccggggcgtgggcctgggggtccctcttcactgcgcagccacctctagcccgccgctttcgggactctcagccttcttttcccttccctgagggccggccggcaccacaacggggccaaaggcagtaactcggttgaaaggcgcgccctgggacaggtcagcgggctccgccatgcgcggcacgcatcccgcaggagcgggtgccagagcagggtaggccgggagttagcagcccagccaggccgctggactcgggctaggggcggggccagcgcagggggcgcaggcgcacaccgcctccgcggcagcatggcggacgcagctcctcaactaggcaagaggaagcgcgaattggacgtggaggaggcccacgccgccagcacagaggaaaaggaggcaggagttggaaatggtacctgtgctcctgtccgcttaccgttctccggcttcagactgcagaaggtgctgagggagtctgcgcgggacaaaatcattttnctacacgggaaggtgaatgaggcctctggggatggggatggagaggatgccgttgtgatcctggagaagacgccatttcaggtggaacaggtggctcagctcctgacgggcagccctgagctccaattgcagttctccaatgatatctacagcacctatcacttgttccctccaagacaactgaatggggacacattggcaatgtctggagacattttgggttgtcacaacttggggagggtgctactaacatcccaacagaggccacagggatgcagctgaacatccttcaatgcacaggacagcccctgcaacagaattatccaggccaaaatgtcagtggtgctgagattgagaaaccctggattaaacatcacagcacttatgtggtgtttactgtgtgccagacattgttttaagaacttcacagatgtaaagacgaccgtggtttaccctgccacagagaaacacctgcagaagtacctgcgccaggacctccgcctgatccgagagacgggagatgactacaggaatattactttaccccacctggagtcccagagcctcagcatccagtgggtgtataacattctcgacaagaaggctgaagcggaccggattgttttcgagaacccagatccctctgatggttttgtcctcatccctgacctcaagtggaaccaacagcagctcgatgacttgtacttgatcgccatctgccatcgccggggcatcagatccctacgcgaccttactccggagcacttgccgctgctcaggaacatcctccaccaggggcaggaggccatcctgcagcgctaccggatgaagggagaccatctgcgagtatacctgcactacctgccctcctactaccacctgcatgtgcacttcaccgccctgggcttcgaggcccccggctcaggcgtggagcgggcccacctgctggctgaggtgatcgagaacttggagtgtgaccctaggcactaccagcagcgcacgctcaccttcgccctcagggctgacgaccccctgctcaagctcttgcaggaggctcagcaaagctgaattaactcaggcagaagagcacagatgtgtgggattgggggaggagtggggacaagattttttatctccaagtgaattttctaaaaatgtattttataccggcttattcctagtattgaataaactagcgggctcactca

SEQ ID NO: 307626 - DNA, 1175 bp, Homo sapiens
gaagtaatctatgggagatattttgagactgtgcctgtgtatcgtgtttcccaacgtgttttcacctgatggtttgattgtttattgagcattgactcctgaccaaactcctcctgaagttcagctgcaggtcaacatcttgacgggcattgaggggacacattggcaatgtctggagacattttgggttgtcacaacttggggagggtgctactaacatcccaacagaggccacagggatgcagctgaacatccttcaatgcacaggacagcccctgcaacagaattatccaggccaaaatgtcagtggtgctgagattgagaaaccctggattaaacatcacagcacttatgtggtgtttactgtgtgccagacattgttttaagaacttcacagatgtaaagacgaccgtggtttaccctgccacagagaaacacctgcagaagtacctgcgccaggacctccgcctgatccgagagacgggagatgactacaggaatattactttaccccacctggagtcccagagcctcagcatccagtgggtgtataacattctcgacaagaaggctgaagcggaccggattgttttcgagaacccagatccctctgatggttttgtcctcatccctgacctcaagtggaaccaacagcagctcgatgacttgtacttgatcgccatctgccatcgccggggcatcagatccctacgcgaccttactccggagcacttgccgctgctcaggaacatcctccaccaggggcaggaggccatcctgcagcgctaccggatgaagggagaccatctgcgagtatacctgcactacctgccctcctactaccacctgcatgtgcacttcaccgccctgggcttcgaggcccccggctcaggcgtggagcgggcccacctgctggctgaggtgatcgagaacttggagtgtgaccctaggcactaccagcagcgcacgctcaccttcgccctcagggctgacgaccccctgctcaagctcttgcaggaggctcagcaaagctgaattaactcaggcagaagagcacagatgtgtgggattgggggaggagtggggacaagattttttatctccaagtgaattttctaaaaatgtattttataccggcttattcctagtattgaataaactagcgggctcactca

SEQ ID NO: 307627 - DNA, 892 bp, Homo sapiens
atctgctgagtgatctagaggatcccactagtcacggttggttacatcattcattgcagttctccaatgatatctacagcacctatcacttgttccctccaagacaactgaatgatgtaaagacgaccgtggtttaccctgccacagagaaacacctgcagaagtacctgcgccaggacctccgcctgatccgagagacgggagatgactacaggaatattactttaccccacctggagtcccagagcctcagcatccagtgggtgtataacattctcgacaagaaggctgaagcggaccggattgttttcgagaacccagatccctctgatggttttgtcctcatccctgacctcaagtggaaccaacagcagctcgatgacttgtacttgatcgccatctgccatcgccggggcatcagatccctacgcgaccttactccggagcacttgccgctgctcaggaacatcctccaccaggggcaggaggccatcctgcagcgctaccggatgaagggagaccatctgcgagtatacctgcactacctgccctcctactaccacctgcatgtgcacttcaccgccctgggcttcgaggcccccggctcaggcgtggagcgggcccacctgctggctgaggtgatcgagaacttggagtgtgaccctaggcactaccagcagcgcacgctcaccttcgccctcagggctgacgaccccctgctcaagctcttgcaggaggctcagcaaagctgaattaactcaggcagaagagcacagatgtgtgggattgggggaggagtggggacaagattttttatctccaagtgaattttctaaaaatgtattttataccggcttattcctagtattgaataaactagcgggctcactca

SEQ ID NO: 307628 - DNA, 1913 bp, Homo sapiens
  misc_feature (518)..(518): n is a, c, g, or t
gggcgtcttcggctcccaccccggggcgtgggcctgggggtccctcttcactgcgcagccacctctagcccgccgctttcgggactctcagccttcttttcccttccctgagggccggccggcaccacaacggggccaaaggcagtaactcggttgaaaggcgcgccctgggacaggtcagcgggctccgccatgcgcggcacgcatcccgcaggagcgggtgccagagcagggtaggccgggagttagcagcccagccaggccgctggactcgggctaggggcggggccagcgcagggggcgcaggcgcacaccgcctccgcggcagcatggcggacgcagctcctcaactaggcaagaggaagcgcgaattggacgtggaggaggcccacgccgccagcacagaggaaaaggaggcaggagttggaaatggtacctgtgctcctgtccgcttaccgttctccggcttcagactgcagaaggtgctgagggagtctgcgcgggacaaaatcattttnctacacgggaaggtgaatgaggcctctggggatggggatggagaggatgccgttgtgatcctggagaagacgccatttcaggtggaacaggtggctcagctcctgacgggcagccctgagctccaattgcagttctccaatgatatctacagcacctatcacttgttccctccaagacaactgaatgatgtaaagacgaccgtggtttaccctgccacagagaaacacctgcagaagtacctgcgccaggacctccgcctgatccgagagacgggagatgactacaggaatattactttaccccacctggagtcccagagcctcagcatccagtgggtgtataacattctcgacaagaaggctgaagcggaccggattgttttcgagaacccagatccctctgatggttttgtcctcatccctgacctcaagtggaaccaacagcagctcgatgacttgtacttgatcgccatctgccatcgccggggcatcagatccctacgcgaccttactccggagcacttgccgctgctcaggaacatcctccaccaggggcaggaggccatcctgcagcgctaccggatgaagggagaccatctgcgagtatacctgcactacctgccctcctactaccacctgcatgtgcacttcaccgccctgggcttcgaggcccccggctcaggcgtggagcgggcccacctgctggctgaggtgatcgagaacttggagtgtgaccctaggcactaccagcagcgcacgctcaccttcgccctcagggctgacgaccccctgctcaagctcttgcaggaggctcagcaaagctgaattaactcaggcagaagagcacagatgtgtgggattgggggaggagtggggacaagattttttatctccaagtgaattttctaaaaatgtattttataccggcttattcctagtattgaataaactagcgggctcactcaaaaaaaaaaaaagaaaaaaagaagacgaaagcactaagagaggggcggcggccgccacctcagaggaagtctcccccgcgggggggggccaccaaccatgatgagacatctgacaccccaacgattcgtgtagagcacacgaagcggcgggcccccacacaaaatgaggaagggctgcgtaaataaatagaacacacggacatcccgagccgcgcgacgatataacagaaaccgagcccggcagacagggcggacaaccgcacgcgtgcacagcagggagagacagaacctggcggtggaaagcagcacacaaccaaacaaatgagctgggggggcgggggcgaaacaaccaaatcgtggggcgcaaacactcacctcacgagcagagaatgacatcagacagccgatcgcagcaggacgacgccaatac

SEQ ID NO: 307629 - DNA, 684 bp, Homo sapiens
  misc_feature (41)..(41): n is a, c, g, or t
ccaaaataccgcgacgcctggaggtggcagcgccccgaccnacaccctctcgtgggtgtataacattctcgacaagaaggctgaagcggaccggattgttttcgagaacccagatccctctgatggttttgtcctcatccctgacctcaagtggaaccaacagcagctcgatgacttgtacttgatcgccatctgccatcgccggggcatcagatccctacgcgaccttactccggagcacttgccgctgctcaggaacatcctccaccaggggcaggaggccatcctgcagcgctaccggatgaagggagaccatctgcgagtatacctgcactacctgccctcctactaccacctgcatgtgcacttcaccgccctgggcttcgaggcccccggctcaggcgtggagcgggcccacctgctggctgaggtgatcgagaacttggagtgtgaccctaggcactaccagcagcgcacgctcaccttcgccctcagggctgacgaccccctgctcaagctcttgcaggaggctcagcaaagctgaattaactcaggcagaagagcacagatgtgtgggattgggggaggagtggggacaagattttttatctccaagtgaattttctaaaaatgtattttataccggcttattcctagtattgaataaactagcgggctcactca

SEQ ID NO: 307630 - DNA, 968 bp, Homo sapiens
  misc_feature (518)..(518): n is a, c, g, or t
gggcgtcttcggctcccaccccggggcgtgggcctgggggtccctcttcactgcgcagccacctctagcccgccgctttcgggactctcagccttcttttcccttccctgagggccggccggcaccacaacggggccaaaggcagtaactcggttgaaaggcgcgccctgggacaggtcagcgggctccgccatgcgcggcacgcatcccgcaggagcgggtgccagagcagggtaggccgggagttagcagcccagccaggccgctggactcgggctaggggcggggccagcgcagggggcgcaggcgcacaccgcctccgcggcagcatggcggacgcagctcctcaactaggcaagaggaagcgcgaattggacgtggaggaggcccacgccgccagcacagaggaaaaggaggcaggagttggaaatggtacctgtgctcctgtccgcttaccgttctccggcttcagactgcagaaggtgctgagggagtctgcgcgggacaaaatcattttnctacacgggaaggtgaatgaggcctctggggatggggatggagaggatgccgttgtgatcctggagaagacgccatttcaggtggaacaggtggctcagctcctgacgggcagccctgagctccaattgcagttctccaatgatatctacagcacctatcacttgttccctccaagacaactgaatgatgtaaagacgtctacacctgccacgtggagcaccccagcctccagaaccccatcatcgtggagtggcggctcctgcactgactcctgagactattttaactgggattggttatcacttttctgtaacgcctgcttgtccctgcccagaattcccagctgcctgtgtcagcctgtccccctgagatcagagtcctacagtggctgtcacgcagccaccaggtcatctcctttcatcccggtgggaagtcgggtgccgagctcg

SEQ ID NO: 307631 - DNA, 724 bp, Homo sapiens
cagagtggctgcctacacttggaaaatgaacaggatctggtctcaagccttcctgagctccaaccagccctgcctgagcgaccttgggtgtatcatctgtcctgctgagcctcacattttccccacgtaaactggcgtgtggggtgagcacagccacagagagctcctctggctgagtgccgagtctgtgaggaaccggagctgggggttcagctgcagttggagctcgacctggatgaatggatggcacatggaggatgctgggtgtcactctgttgcccaggctggagtgcagtgatgagatctgagcccattgcaacctctgcctcctgggttaagcgatcctcccacctttgcctcccaagcagctggattacagacactgaagactcagcagagatcaagagagacaatatttcctgtacttctggaactcatggaagctggagagagacagaatttgcaaatgtctctcagcctgagtttccttccagaatttccatgaaccagggggttggctgcagtgtctgttgaaagatgtggctgggggtatgaagggactgccttgaagctgagtgaccatggcaggctcaccttataaaactatggatggggctcaaccccagccacgctgtcctcgtgctcctgagtacagggtctcgggcccctccaggtcctactctgaagcagccacggctgctggaagaaggtccggacgaacggg

SEQ ID NO: 307632 - DNA, 3124 bp, Homo sapiens
ccgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagta

SEQ ID NO: 307633 - DNA, 3235 bp, Homo sapiens
ccgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagtagctgcgattgggtatgtgtttcctgggttaggggaaggactctgccctattgagggctgtgaggttttctgaagacttggcctttagagatacaaggatcctccagccagc

SEQ ID NO: 307634 - DNA, 467 bp, Homo sapiens
gaacattgcaatgtgctgctatcaattattaactacctcgggagtcactggtagccggcccggtctcttgcctggcagctcgggtcgtcctcgtcctccagtgattgctttccagtaaccaggcctcccgcttctctctctcctgccagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccactctcaagtagctgctattacaggcacacgccaccatgcctggctaattttgttgcttttgtagagacaaagttatatacctgatgcagctcag

SEQ ID NO: 307635 - DNA, 874 bp, Homo sapiens
ccgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccaagcacgccaccacaccaggccaccccagcgcaagtgccttccttggacgcagagaggagccattcgtcctcct

SEQ ID NO: 307636 - DNA, 509 bp, Homo sapiens
agccaaacggtcacttgtttaagcaaacacaagtacaaagtaaaatagaaccacaaaataatgaactgcatgttcataacatacaaaaatcgccgcctactcagtaggtaactacaacattccaactcctgaatatatttataaatttacattttcagttaaaaaaatagacttttgagagttcagattttgttttagattttgttttcttacattctggagaaccgaatcccagctcatcaaacccagccgcatgcgcaagtaccccaaccggcccagcaagacgcccccccacgaacgcccttacgcttgcccagtggagtcctgtgatcgccgcttctcccgctcccaaagcctcccccaaatcatcactccctgccccccttaaggctagaggtgagcatgtccctcacaattgcacatgtcaagccatcagcaaggcgcatcacacaaaaggcaccaagacgtgaaactttttaaaccaaaaggacgaagaaaaaacactttca

SEQ ID NO: 307637 - DNA, 2696 bp, Homo sapiens
gaacattgcaatgtgctgctatcaattattaactacctcgggagtcactggtagccggcccggtctcttgcctggcagctcgggtcgtcctcgtcctccagtgattgctttccagtaaccaggcctcccgcttctctctctcctgccagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagta

SEQ ID NO: 307638 - DNA, 2531 bp, Homo sapiens
attgaaggctgggatagctcatccagaactggatgcaatcatgatgggcgcatcagcttcgatgagtactggaccttgataggcggcatcaccggccccagtcgccaaactcatccatgagcaggagcagcagagcagcagctagagacccctttggccacaccttccaggcactggcctgatgccccgccctggtgctctccccagggcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagta

SEQ ID NO: 307639 - DNA, 2146 bp, Homo sapiens
  misc_feature (145)..(145): n is a, c, g, or t
gagacagagtctcgctgtcccccaggctggagtgcagtggcgtcatctcggctcactgcaggctctgccccccgggttcatgccattctcctgcctcaccctcccgagtagctgggagtacaggcgcccgccagggtggcaaagnccttaatagtagacagaggggttagcgaaggctgctgggtgcggctctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagta

SEQ ID NO: 307640 - DNA, 1666 bp, Homo sapiens
  misc_feature (23)..(23): n is a, c, g, or t
gatgatcgagctcggtaccgtangatgagcgagagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagta

SEQ ID NO: 307641 - DNA, 1533 bp, Homo sapiens
  misc_feature (33)..(33): n is a, c, g, or t
aaggggaagtgggcagaaaggattgttggccantagaccttccactccagtagagagggaggactggctctgagaacctccatctgacctaagaggaaccctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagta

SEQ ID NO: 307642 - DNA, 3282 bp, Homo sapiens
ccgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagtataaaaaaccacaatatatatacagctacacacactaacaaaaaaaaggggggcgcggggctaaaaagattcccccgagaggggcgcaaagtttacgtaacaccccagttttttgaaagaaggggggccccattggaggaccgaaaaaaagacaaggga

SEQ ID NO: 307643 - DNA, 1258 bp, Homo sapiens
ctcgttacccctgggctggggaaaagggctgggctggagaacagggctgggctggggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagta

SEQ ID NO: 307644 - DNA, 1216 bp, Homo sapiens
cttgcatgtaccggggacgggtaagaggtagcaaccggggacgggtaggaagagagagaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagta

SEQ ID NO: 307645 - DNA, 3250 bp, Homo sapiens
ccgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtacacctcaaccgactctctcgcatctcatcaatcctcgcctatcctactctcgcaggcccccttgtcccagctgtcttttgttcccgcagccttctcatccccccctctctggctcacttgtccatctcgccctatcctggctccctttccttttctctct

SEQ ID NO: 307646 - DNA, 3142 bp, Homo sapiens
ccgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtaacaccacatatcccagtcgacggccgctgtatttagtagtagtagcgacagc

SEQ ID NO: 307647 - DNA, 3070 bp, Homo sapiens
ccgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagta

SEQ ID NO: 307648 - DNA, 1173 bp, Homo sapiens
  misc_feature (33)..(33): n is a, c, g, or t
aaggggaagtgggcagaaaggattgttggccantagaccttccactccagtagagagggaggactggctctgagaacctccatctgacctaagaggaaccctcctctcctatggccatctcctctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagta

SEQ ID NO: 307649 - DNA, 700 bp, Homo sapiens
  misc_feature (21)..(21): n is a, c, g, or t
atgatcagccggtaccgacancatagaatggtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagta

SEQ ID NO: 307650 - DNA, 3006 bp, Homo sapiens
ccgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatcttctgcatgataaggtgatcttctacacgataggtgatcttctgcaagata

SEQ ID NO: 307651 - DNA, 3073 bp, Homo sapiens
ccgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagta

SEQ ID NO: 307652 - DNA, 2770 bp, Homo sapiens
ccgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtccccgtacatcgttagaagcttgaattcgagcgtagtagtagtagtagtaggcggccgc

SEQ ID NO: 307653 - DNA, 2266 bp, Homo sapiens
ccgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatagcattgaagggagcaaggggtcaggcatatgatggagatgatactgaaagtcga

SEQ ID NO: 307654 - DNA, 2259 bp, Homo sapiens
ccgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccattgagcctgtgtctagacacaggctcaagatgggacaagaattaagacc

SEQ ID NO: 307655 - DNA, 2326 bp, Homo sapiens
ccgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttcacgtactcctctgttccccctgctttcccggtccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggag

SEQ ID NO: 307656 - DNA, 1865 bp, Homo sapiens
ccgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgctcatggggtacgagctaattgtat

SEQ ID NO: 307657 - DNA, 1660 bp, Homo sapiens
ccgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtcctggcctgagatgggatcctctagacacctcagca

SEQ ID NO: 307658 - DNA, 1697 bp, Homo sapiens
ccgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggcctgcttggcacccccatctgaaagagcagcacttctcagcta

SEQ ID NO: 307659 - DNA, 1645 bp, Homo sapiens
ccgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtcctgcctgagattcgtcctggcctgcgatcgtcctggcctgagat

SEQ ID NO: 307660 - DNA, 810 bp, Homo sapiens
ccgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttgcctttggcagatgcctgatgtatttcgatacatgcctagcaccccacaacccccacttgtagcacccattgacac

SEQ ID NO: 307661 - DNA, 676 bp, Homo sapiens
gtggggtcaggaaatgtggctaggatttgatggagatctccctgggtaataagagggattttggtgagaagaaagactgtgagctggagcccaatatctttagtgaatataatacacgacctggaaattagtagagcatagtaacttggtgcagccatgtaagtgccagacagactttagttcaaatcacagctccaccgtggaccactgctagtttttgggcatgttgcttaccatgtcgaatcacagtacactcaactataaactgtgagaaataaatacgtctatcccacagagctgttatgtgtagcagatgctagtataataattacctacccaacaaccatttgcatcttcttttttactaacaaaacaaaatcctttatgaagctaaatgctcaagctaagttggtcccagccttagacccactgggtagatcttgattcgtcttagccagtcatggtgatcccttcttcctttccaatgattgacttatgaaagactcaatactggacagtgtgatgtaggataagctaagatgacttctgggaaatatttcctatctttttactttggtgtgtgaagatgtgatgccaagagcttctgcagctatcctgaggaaaactagcagataagctaagcttaatgaaagaaacccttagttaccgtctcaaa

SEQ ID NO: 307662 - DNA, 679 bp, Homo sapiens
tattcaatgccttcttcaagattctgtgctttgaattgggtgtcatgaataatagttttgttgacctttgtccacaaaatactgtttctttcttttctctccaggtggtaacctatgacggggcttccaccattgttgactggttcatgccactgtatgaccatggagtctttggaaatggctgtggcaaatggtgtacctggagggcctggttctttgtagggatattgagctacaattggatcagactctaaggcaaagctttgtccatatctgttttcggcaaatattctaaattggtattctgtaccagttttcagtttggtcactttgagtgtagttctagcaacagtagcagaaacaacatcccatactgtggtggttgtatctcttttctgaacaatgtagttggtgatttggcagccccctgtatataatggagggttccaagataatgtaatactttcagcactgacgtcatcaaatttaacaggtccttttggaggatcaggtttatctagagttacaatttcgatggatgctgtcttctgaccaacaacattggcaactgtgattccatattgtccaccatcatccttatgagtttctttaatactgagtgtggtgagatccagtgaatcggtaacattgattcttgtggtctgcttcagtgggagac

SEQ ID NO: 307663 - DNA, 8510 bp, Homo sapiens
  misc_feature (5076)..(5076): n is a, c, g, or t
cgtcatggccgtcagcaccgcgttcccgtcctcttccgcttggccccagaaagtttcggttctgcccggcggtggacccacgagcgcgtgccaccatggagtctgaccactgctgagcagacagccaccgagggccgaaattctgagccttcctctggacccaggcaggagacatacagacaagaaaggcaaactcaccatggcctccaccaatgcagagagccagctccagagaatcatccgagacttgcaagatgctgtgacagaactaagcaaagaatttcaggaagcaggggaacccatcacggatgacagcaccagcttgcataaattttcttataaacttgagtatctcctgcaatttgatcagaaagagaaggccaccctcctgggcaacaagaaggactactgggattacttctgtgcctgcctggccaaggtgaaaggagccaatgatgggatccgatttgtcaagtctatctcagagctccgaacatccttggggaaaggaagagcatttattcgctactccttggtgcaccagaggttggcagacaccttacagcagtgcttcatgaacaccaaagtgaccagtgactggtactatgcaagaagcccctttctgcagccaaagctgagctcggacattgtgggccaactctatgagctgactgaggttcagtttgacctggcgtcgaggggctttgacttggatgctgcctggccaacatttgccaggaggacgctgaccactggctcttctgcttacctgtggaaaccccctagccgcagctccagcatgagcagcttggtgagcagctacctgcagactcaagagatggtgtccaactttgacctgaacagccccctaaacaacgaggcattggagggctttgatgagatgcgactagagctggaccagttggaggtgcgggagaagcagctacaggagcgcatgcagcagctggacagagagaaccaggagctgagggcagctgtcagccagcaaggggagcaactgcagacagagagggagagggggcgcactgcagcggaggacaacgttcgcctcacttgcttggtagctgagctccagaagcagtgggaggtcacccaggccacccagaacactgtgaaggagctgcagacatgcctgcaggccctggagctaggagcagcagagaaggaggaggactaccacacagccctgcggcggctggagtccatgctgcagcccttggcacaggagcttgaggccacacgggactcactggacaagaaaaaccagcatttagccagcttcccaggctggctagccatggctcagcagaaggcagatacggcatcagacacaaagggccggcaagaacctattcccagtgatgcggcccaggagatgcaggagctaggggagaagcttcaagccctagaaagggagagaaccaaggtcgaggaggtcaacagacagcagagtgcccaactggaacagctggtcaaggagcttcagctgaaagaggatgcccgggccagcctggagcgcctggtgaaggagatggccccactccaggaggagttgtctgggaagggacaggaggcagaccagctctggcgacggctgcaggagttgctggcccacacgagctcctgggaggaggagctagcagagttgaggcgggagaaaaaacagcaacaggaggagaaggagctgctggagcaggaggtcaggtctctgacccggcagctgcagttcctggagacccagctggcacaggtgagccaacatgtgagtgacctggaggagcagaagaagcagctcattcaggacaaagaccacctcagccagcaggtgggtatgctcgagcggcttgctgggccgcctggcccagaactgccagtggcaggtgagaagaatgaggccctggtccctgtgaactccagtctgcaagaggcctgggggaagccagaggaggagcagaggggcctgcaggaggcacagttagacgataccaaggtgcaagagggcagccaggaggaagagctccggcaggccaacagggagctggagaaggagctacagaatgtggtcgggcgtaaccagctcctggagggcaagctgcaagccctgcaggccgattaccaggctttgcagcagcgggaatcagccatccagggctccttggcctccctggaggccgagcaggccagcatccggcacttgggtgaccagatggaggcgagcttgctggctgtaaggaaggccaaggaggccatgaaagcccagatggcagagaaggaggccattctacagagcaaggagggcgagtgtcagcagctgcgggaggaggtggagcagtgccagcaactggcagaagcccggcacagagagcttagggctctcgagagccagtgccagcagcagacccagctgattgaggtcctcacagcagagaaaggccaacagggagttggcccacccactgacaatgaagcccgtgagctggctgcccagctagccctgtctcaggcgcagctggaagtccatcagggggaggtccaacggctgcaggctcaggtggtggacctccaggccaagatgcgggcagccctggatgaccaggacaaggtgcagagccagctaagcatggctgaggccgtcctgagggagcacaaaacccttgtgcagcagctgaaggagcagaatgaagcccttaacagagcccatgtccaggagctgctgcaatgctcggagcgtgaaggggcactgcaggaggagagggccgatgaggcccagcagagggaggaggagctgcgggccctgcaggaggagctgtcccaggccaaatgcagctccgaggaagcacagctggagcacgctgagctgcaagagcagctgcaccgggccaacacagacacagctgagctgggcatccaggtttgcgcactgaccgtggaaaaggagcgagtggaggaggcactggcctgtgctgtccaggagctccaggacgccaaagaggcagcctcaagggagcgagagggcctggagcgccaagtagctgggctgcagcaagagaaggagagcttgcaggagaagctgaaggcggccaaggcagcagccggctcactgcctggcctgcaggcccagctcgcccaggcagagcagcgggcccagagcctccaagaggctgcacaccaggagctcaacaccctcaagttccagctgagtgctgaaatcatggactaccagagcagacttaagaatgctggtgaagagtgcaagagcctcaggggccagcttgaggagcaaggccggcagctgcaggctgctgaggaagctgtggagaagctgaaggccacccaagcagacatgggagagaagctgagctgcactagcaaccatcttgcagagtgccaggcggccatgctgaggaaggacaaggagggggctgccctgcgtgaagacctagaaaggacccagaaggaactcgaaaaagccacaacaaaaatccaagagtattacaacaaactctgccaggaggtgacaaatcgtgagaggaatgaccagaagatgcttgctgacctggatgacctcaacagaaccaagaagtatctcgaggagcggctgatagagctgctcagggacaaggatgctctctggcagaagtcagatgccctggaattccagcagaagctcagtgctgaggagagatggctcggagacacagaggcaaaccactgcctcgactgtaagcgggagttcagctggatggtgcggcggcaccactgcaggatatgtggccgcatcttctgttactactgctgcaacaactacgtcctgagcaagcacggtggcaaaaaggagcgctgctgccgagcctgtttccagaagctcagtgaaggccctggctcccctgatagcagtggctcaggcactagccagggagagcccagccctgcactgtcaccagcctcacctgggccccaggccacaggaggccaaggagcaaatacagactacaggccaccggacgacgctgtgtttgatatcatcacagatgaggaattgtgccagatacaggagtccggctcctctttgcctgaaacacccactgaaactgattctcttgacccaaatgcggctgaacaggatactacatcaacctcgctaacgcctgaggacactgaagacatgcccgtggggcaggattcggaaatctgcctgctgaagtctggagaactgatgatcaaagtacccctcacagtggatgagatcgccagcttcggggagggtagcagggagctgtttgtgaggtccagcacctacagcctgatccccatcactgtggccgaggcaggcctcaccatcagctgggtcttctcctctgaccccaagagcatctccttcagtgtggtcttccaggaggccgaggacacaccgctggatcagtgtaaggtcctcattcccacgacccgatgcaactcccacaaggagaacatccagggccagctcaaggttcgcacacccggcatctacatgctcatcttcgacaataccttctcaaggtttgtctctaaaaaggtattttatcacttgacggttgatcggcctgtgatctacgatggaagtgatttcctgtagcttcagcacctcagtaacttcacttcatccacaggaaacactgctcttcctcacctgtcacataaagcatttttttaaaaagtcagctgctccaaaatcatcaactcagcccctgggctgcccctcagaggcggtgtctggggaggactttgtgctcagcactctgcaccggccactcttagcccccgaggcgttgaagggctcaggcaatgtttccattaagtagagactcagctgttgtcacacccaaagggatgctctgccaaaggtttaaacacccaggagaccatcagcctctcctgggagcacagttgactacaggcctcttgtggagagtttcacgggcaggggtgattccaacttctgcctgtggagagattttctgccctgccccaccagggccctgcatgttggagactgagctgggtgcactggccatnccctgtgaatcctcgggctgtgacgccctcaggtactcctgggaaaaggaggtacacagccatcatgcgagtcggtgccaggggaccccccggagatcctgaccagctcctccagtcatgctcttgtccctcactgccccagtaagctggaggctgctccagaactcagcagtgttggaggggcctctaagctgcactctctttctggcccttttgtctggctgattctgtcctcaaataaagcccttcactcagccagacctctccacagctcaaagcattgccctaagaatcagaagtaaagataatccaagagcaaaacccactgtacttggggcctgcaatggctgtgtgtacactacatctaatgcccaaatgccagccagtgtggatgttgtgaccacagagcaggattgtgcattggctttagagctactcctcagctgatggcccacttttgtttatataaataagagcttctgccccacctgcagacatgtttactaatgatcatagccaggattagaaccactttcaaacattggggccttcttaacaaaagtctttgataacttaagaaccaaagtaacagagtaaacagaggcatgatggatccctgggccccactcccctcctgacaggttccccaacagcccatttgcccacttcccactgctcagcccacaccagacctccaggagacatccccccttgaggcagagagatcctgttccctattcccagacaagaattatttaatcttccctgttctctgtggtccttttcttccccaacaacagatagctcaccttggacagctcttcgtcccttgttcatggaaccagctgcctgcagtcaggccccaggttcttccatgggtgaacagagcatctgacaaaaggtcccagtttggccaggggtgagggagagagcaccagacaggctatccgagaatctgagagctgggcccggcaattcctccagctacccttgtgacctaagtccagtcacacatttcccaaagtttctctttgtcataaccctggtctggctggttttgagggcttgagaatgggtcagggactccaggccaagtccaacagagaccccaaacccaccacacaccagcagccacaacctcaccaccaacaaagaggacttttgtggggccacaagtaagaggtcatttctggaatggactcagacctttaaacaggagagttgagcacttccagtcagtttttaagcaaggcatggggaacagggaatagaacctttcaaagaggttgcccagagaaaagctgggcctcttgcattcggcttccttggagcagcctcttctggcagaaagccatcaggtgctcaatcatcttctcctggccaaggctctgaccatgcttagtactggaatagaggtggccaggcccccagcgactcttcttggcctgatgtttgtcctcacaggcatgccacgtggcctgagatgattcagaacaaatcatgctaactttgaatccatccagccacttgcaaatgataatcagaagtcagcttgttcactgttagaaagaaactaacaaaagagaacccagagcaatctagaatctttgagtgcttggctttccaaggatactgcggagactctggccaagctgatgaccttctgaagtgtcactggcaccatatgcaacaagaaccaccattcactgagtagctaatgggtttggggcctgggacattccatctgaggtccttcctgaacatgtcactccacagcagaggaccggttgcagcttacccagaaccactcctccaggagagctggatgttttgcgtgcaacaccttgagcactgactgctattgttcaaaaaaagcctttgctgcattcggaggactgccccgtgccctgaggtgacttcctaactatgtggtttcattagcgaatttatttttgtgctgggtggacatttgtattttgttaggttgctgtttaagctcaagtttgctgtgctctctgcagctacaaaacatcttggcatatttaagagtggcttttataaatagctttattctgatattaatcagattcccaactttactgagaattaaggactggggtactttaaagaaatgcaaatagcaattgaagaaccactgctgcaggtggtagccctggctagactgaattacactagaaatcagccagaaggaagcgtccttgggatcccagatcactcttttttttttttttttttaaaaggggcagccccttgatggctcatctctctgaataacagttacgtcttcatatcgataccagatgccttcttcatcatgccactgaagccactcaccaccttcaagaacatgccaacctctgtcagattcacttacccacaaacaaggaggcacgtttggcacaaagtgttgtcctccaggtccaagtggactctacagagtgcttgacctcaacacactggattccaggtggactggaccaagagcaggcaaagacacgggaactgaaaaactccacagggtttggagaatagaaatgaaaagccacgtcatataactcaagaataaatggtgttttggaaattttaaaattatcatcgaaggtggtgaaactatttcaggcccaaatgaaaggaaatcgccagttggggatgaaatcacagagcctgtgttttatgatatggttggatgtccactgatgaaattttaaaggagtttcatttttaaaagtgcgcatgattctacatatgagaattctttaggccaagaaactgtccttggctcagaggtgttgggaattaaagcagagagaagccattcgtgatgcttagaaccaaggatggtcatgtacacaaagaccatcgagacggccattcttgtttacaaaacacttaccaagaaagcactttgtaggggaactttagtaagttcttctcatttcattatgtttcttccaaggaaacaggagagactgaattaataattctctctttcctcttaagcacttttaaaataataaagtacatcttgaaatttggggaggcatctctgatttaaaaaaagaaaaaggctgcttgatgtatgttatgcagagacactctgcctctggtggctgcagagcaatacccaagcctcatttggaaggctcaacatttggaattgcactttaattgattaatcctcaattcatgtggccttacgggatggtgggtctgggaccccaattcattcttatctgccaaagaattatctagaagcacatcaaataccagcaccccacctgcacaatgggggtggaaaacttttgtatccctaagcatattattttatagtgtctgccatgccatgtggaaatactttatttttaacctcaggatttaaataaagtaaacactatgacatttaaaaaaaaaac

SEQ ID NO: 307664 - DNA, 8456 bp, Homo sapiens
  misc_feature (5076)..(5076): n is a, c, g, or t
cgtcatggccgtcagcaccgcgttcccgtcctcttccgcttggccccagaaagtttcggttctgcccggcggtggacccacgagcgcgtgccaccatggagtctgaccactgctgagcagacagccaccgagggccgaaattctgagccttcctctggacccaggcaggagacatacagacaagaaaggcaaactcaccatggcctccaccaatgcagagagccagctccagagaatcatccgagacttgcaagatgctgtgacagaactaagcaaagaatttcaggaagcaggggaacccatcacggatgacagcaccagcttgcataaattttcttataaacttgagtatctcctgcaatttgatcagaaagagaaggccaccctcctgggcaacaagaaggactactgggattacttctgtgcctgcctggccaaggtgaaaggagccaatgatgggatccgatttgtcaagtctatctcagagctccgaacatccttggggaaaggaagagcatttattcgctactccttggtgcaccagaggttggcagacaccttacagcagtgcttcatgaacaccaaagtgaccagtgactggtactatgcaagaagcccctttctgcagccaaagctgagctcggacattgtgggccaactctatgagctgactgaggttcagtttgacctggcgtcgaggggctttgacttggatgctgcctggccaacatttgccaggaggacgctgaccactggctcttctgcttacctgtggaaaccccctagccgcagctccagcatgagcagcttggtgagcagctacctgcagactcaagagatggtgtccaactttgacctgaacagccccctaaacaacgaggcattggagggctttgatgagatgcgactagagctggaccagttggaggtgcgggagaagcagctacaggagcgcatgcagcagctggacagagagaaccaggagctgagggcagctgtcagccagcaaggggagcaactgcagacagagagggagagggggcgcactgcagcggaggacaacgttcgcctcacttgcttggtagctgagctccagaagcagtgggaggtcacccaggccacccagaacactgtgaaggagctgcagacatgcctgcaggccctggagctaggagcagcagagaaggaggaggactaccacacagccctgcggcggctggagtccatgctgcagcccttggcacaggagcttgaggccacacgggactcactggacaagaaaaaccagcatttagccagcttcccaggctggctagccatggctcagcagaaggcagatacggcatcagacacaaagggccggcaagaacctattcccagtgatgcggcccaggagatgcaggagctaggggagaagcttcaagccctagaaagggagagaaccaaggtcgaggaggtcaacagacagcagagtgcccaactggaacagctggtcaaggagcttcagctgaaagaggatgcccgggccagcctggagcgcctggtgaaggagatggccccactccaggaggagttgtctgggaagggacaggaggcagaccagctctggcgacggctgcaggagttgctggcccacacgagctcctgggaggaggagctagcagagttgaggcgggagaaaaaacagcaacaggaggagaaggagctgctggagcaggaggtcaggtctctgacccggcagctgcagttcctggagacccagctggcacaggtgagccaacatgtgagtgacctggaggagcagaagaagcagctcattcaggacaaagaccacctcagccagcaggtgggtatgctcgagcggcttgctgggccgcctggcccagaactgccagtggcaggtgagaagaatgaggccctggtccctgtgaactccagtctgcaagaggcctgggggaagccagaggaggagcagaggggcctgcaggaggcacagttagacgataccaaggtgcaagagggcagccaggaggaagagctccggcaggccaacagggagctggagaaggagctacagaatgtggtcgggcgtaaccagctcctggagggcaagctgcaagccctgcaggccgattaccaggctttgcagcagcgggaatcagccatccagggctccttggcctccctggaggccgagcaggccagcatccggcacttgggtgaccagatggaggcgagcttgctggctgtaaggaaggccaaggaggccatgaaagcccagatggcagagaaggaggccattctacagagcaaggagggcgagtgtcagcagctgcgggaggaggtggagcagtgccagcaactggcagaagcccggcacagagagcttagggctctcgagagccagtgccagcagcagacccagctgattgaggtcctcacagcagagaaaggccaacagggagttggcccacccactgacaatgaagcccgtgagctggctgcccagctagccctgtctcaggcgcagctggaagtccatcagggggaggtccaacggctgcaggctcaggtggtggacctccaggccaagatgcgggcagccctggatgaccaggacaaggtgcagagccagctaagcatggctgaggccgtcctgagggagcacaaaacccttgtgcagcagctgaaggagcagaatgaagcccttaacagagcccatgtccaggagctgctgcaatgctcggagcgtgaaggggcactgcaggaggagagggccgatgaggcccagcagagggaggaggagctgcgggccctgcaggaggagctgtcccaggccaaatgcagctccgaggaagcacagctggagcacgctgagctgcaagagcagctgcaccgggccaacacagacacagctgagctgggcatccaggtttgcgcactgaccgtggaaaaggagcgagtggaggaggcactggcctgtgctgtccaggagctccaggacgccaaagaggcagcctcaagggagcgagagggcctggagcgccaagtagctgggctgcagcaagagaaggagagcttgcaggagaagctgaaggcggccaaggcagcagccggctcactgcctggcctgcaggcccagctcgcccaggcagagcagcgggcccagagcctccaagaggctgcacaccaggagctcaacaccctcaagttccagctgagtgctgaaatcatggactaccagagcagacttaagaatgctggtgaagagtgcaagagcctcaggggccagcttgaggagcaaggccggcagctgcaggctgctgaggaagctgtggagaagctgaaggccacccaagcagacatgggagagaagctgagctgcactagcaaccatcttgcagagtgccaggcggccatgctgaggaaggacaaggagggggctgccctgcgtgaagacctagaaaggacccagaaggaactcgaaaaagccacaacaaaaatccaagagtattacaacaaactctgccaggaggtgacaaatcgtgagaggaatgaccagaagatgcttgctgacctggatgacctcaacagaaccaagaagtatctcgaggagcggctgatagagctgctcagggacaaggatgctctctggcagaagtcagatgccctggaattccagcagaagctcagtgctgaggagagatggctcggagacacagaggcaaaccactgcctcgactgtaagcgggagttcagctggatggtgcggcggcaccactgcaggatatgtggccgcatcttctgttactactgctgcaacaactacgtcctgagcaagcacggtggcaaaaaggagcgctgctgccgagcctgtttccagaagctcagtgaaggccctggctcccctgatagcagtggctcaggcactagccagggagagcccagccctgcactgtcaccagcctcacctgggccccaggccacaggaggccaaggagcaaatacagactacaggccaccggacgacgctgtgtttgatatcatcacagatgaggaattgtgccagatacaggagtccggctcctctttgcctgaaacacccactgaaactgattctcttgacccaaatgcggctgaacaggatactacatcaacctcgctaacgcctgaggacactgaagacatgcccgtggggcaggattcggaaatctgcctgctgaagtctggagaactgatgatcaaagtacccctcacagtggatgagatcgccagcttcggggagggtagcagggagctgtttgtgaggtccagcacctacagcctgatccccatcactgtggccgaggcaggcctcaccatcagctgggtcttctcctctgaccccaagagcatctccttcagtgtggtcttccaggaggccgaggacacaccgctggatcagtgtaaggtcctcattcccacgacccgatgcaactcccacaaggagaacatccagggccagctcaaggttcgcacacccggcatctacatgctcatcttcgacaataccttctcaaggtttgtctctaaaaaggtattttatcacttgacggttgatcggcctgtgatctacgatggaagtgatttcctgtagcttcagcacctcagtaacttcacttcatccacaggaaacactgctcttcctcacctgtcacataaagcatttttttaaaaagtcagctgctccaaaatcatcaactcagcccctgggctgcccctcagaggcggtgtctggggaggactttgtgctcagcactctgcaccggccactcttagcccccgaggcgttgaagggctcaggcaatgtttccattaagtagagactcagctgttgtcacacccaaagggatgctctgccaaaggtttaaacacccaggagaccatcagcctctcctgggagcacagttgactacaggcctcttgtggagagtttcacgggcaggggtgattccaacttctgcctgtggagagattttctgccctgccccaccagggccctgcatgttggagactgagctgggtgcactggccatnccctgtgaatcctcgggctgtgacgccctcaggtactcctgggaaaaggaggtacacagccatcatgcgagtcggtgccaggggaccccccggagatcctgaccagctcctccagtcatgctcttgtccctcactgccccagtaagctggaggctgctccagaactcagcagtgttggaggggcctctaagctgcactctctttctggcccttttgtctggctgattctgtcctcaaataaagcccttcactcagccagacctctccacagctcaaagcattgccctaagaatcagaagtaaagataatccaagagcaaaacccactgtacttggggcctgcaatggctgtgtgtacactacatctaatgcccaaatgccagccagtgtggatgttgtgaccacagagcaggattgtgcattggctttagagctactcctcagctgatggcccacttttgtttatataaataagagcttctgccccacctgcagacatgtttactaatgatcatagccaggattagaaccactttcaaacattggggccttcttaacaaaagtctttgataacttaagaaccaaagtaacagagtaaacagaggcatgatggatccctgggccccactcccctcctgacaggttccccaacagcccatttgcccacttcccactgctcagcccacaccagacctccaggagacatccccccttgaggcagagagatcctgttccctattcccagacaagaattatttaatcttccctgttctctgtggtccttttcttccccaacaacagatagctcaccttggacagctcttcgtcccttgttcatggaaccagctgcctgcagtcaggccccaggttcttccatgggtgaacagagcatctgacaaaaggtcccagtttggccaggggtgagggagagagcaccagacaggctatccgagaatctgagagctgggcccggcaattcctccagctacccttgtgacctaagtccagtcacacatttcccaaagtttctctttgtcataaccctggtctggctggttttgagggcttgagaatgggtcagggactccaggccaagtccaacagagaccccaaacccaccacacaccagcagccacaacctcaccaccaacaaagaggacttttgtggggccacaagtaagaggtcatttctggaatggactcagacctttaaacaggagagttgagcacttccagtcagtttttaagcaaggcatggggaacagggaatagaacctttcaaagaggttgcccagagaccatcaggtgctcaatcatcttctcctggccaaggctctgaccatgcttagtactggaatagaggtggccaggcccccagcgactcttcttggcctgatgtttgtcctcacaggcatgccacgtggcctgagatgattcagaacaaatcatgctaactttgaatccatccagccacttgcaaatgataatcagaagtcagcttgttcactgttagaaagaaactaacaaaagagaacccagagcaatctagaatctttgagtgcttggctttccaaggatactgcggagactctggccaagctgatgaccttctgaagtgtcactggcaccatatgcaacaagaaccaccattcactgagtagctaatgggtttggggcctgggacattccatctgaggtccttcctgaacatgtcactccacagcagaggaccggttgcagcttacccagaaccactcctccaggagagctggatgttttgcgtgcaacaccttgagcactgactgctattgttcaaaaaaagcctttgctgcattcggaggactgccccgtgccctgaggtgacttcctaactatgtggtttcattagcgaatttatttttgtgctgggtggacatttgtattttgttaggttgctgtttaagctcaagtttgctgtgctctctgcagctacaaaacatcttggcatatttaagagtggcttttataaatagctttattctgatattaatcagattcccaactttactgagaattaaggactggggtactttaaagaaatgcaaatagcaattgaagaaccactgctgcaggtggtagccctggctagactgaattacactagaaatcagccagaaggaagcgtccttgggatcccagatcactcttttttttttttttttttaaaaggggcagccccttgatggctcatctctctgaataacagttacgtcttcatatcgataccagatgccttcttcatcatgccactgaagccactcaccaccttcaagaacatgccaacctctgtcagattcacttacccacaaacaaggaggcacgtttggcacaaagtgttgtcctccaggtccaagtggactctacagagtgcttgacctcaacacactggattccaggtggactggaccaagagcaggcaaagacacgggaactgaaaaactccacagggtttggagaatagaaatgaaaagccacgtcatataactcaagaataaatggtgttttggaaattttaaaattatcatcgaaggtggtgaaactatttcaggcccaaatgaaaggaaatcgccagttggggatgaaatcacagagcctgtgttttatgatatggttggatgtccactgatgaaattttaaaggagtttcatttttaaaagtgcgcatgattctacatatgagaattctttaggccaagaaactgtccttggctcagaggtgttgggaattaaagcagagagaagccattcgtgatgcttagaaccaaggatggtcatgtacacaaagaccatcgagacggccattcttgtttacaaaacacttaccaagaaagcactttgtaggggaactttagtaagttcttctcatttcattatgtttcttccaaggaaacaggagagactgaattaataattctctctttcctcttaagcacttttaaaataataaagtacatcttgaaatttggggaggcatctctgatttaaaaaaagaaaaaggctgcttgatgtatgttatgcagagacactctgcctctggtggctgcagagcaatacccaagcctcatttggaaggctcaacatttggaattgcactttaattgattaatcctcaattcatgtggccttacgggatggtgggtctgggaccccaattcattcttatctgccaaagaattatctagaagcacatcaaataccagcaccccacctgcacaatgggggtggaaaacttttgtatccctaagcatattattttatagtgtctgccatgccatgtggaaatactttatttttaacctcaggatttaaataaagtaaacactatgacatttaaaaaaaaaac

SEQ ID NO: 307665 - DNA, 6624 bp, Homo sapiens
  misc_feature (3190)..(3190): n is a, c, g, or t
cgtcatggccgtcagcaccgcgttcccgtcctcttccgcttggccccagaaagtttcggttctgcccggcggtggacccacgagcgcgtgccaccatggagtctgaccactgctgagcagacagccaccgagggccgaaattctgagccttcctctggacccaggcaggagacatacagacaagaaaggcaaactcaccatggcctccaccaatgcagagagccagctccagagaatcatccgagacttgcaagatgctgtgacagaactaagcaaagaatttcaggaagcaggggaacccatcacggatgacagcaccagcttgcataaattttcttataaacttgagtatctcctgcaatttgatcagaaagagaaggccaccctcctgggcaacaagaaggactactgggattacttctgtgcctgcctggccaaggtgaaaggagccaatgatgggatccgatttgtcaagtctatctcagagctccgaacatccttggggaaaggaagagcatttattcgctactccttggtgcaccagaggttggcagacaccttacagcagtgcttcatgaacaccaaagtgaccagtgactggtactatgcaagaagcccctttctgcagccaaagctgagctcggacattgtgggccaactctatgagctgactgaggttcagtttgacctggcgtcgaggggctttgacttggatgctgcctggccaacatttgccaggaggacgctgaccactggctcttctgcttacctgtggaaaccccctagccgcagctccagcatgagcagcttggtgagcagctacctgcagactcaagagatggtgtccaactttgacctgaacagccccctaaacaacgaggcattggagggctttgatgagatgcgactagagctggaccagttggaggtgcgggagaagcagctacaggagcgcatgcagcagctggacagagagaaccaggagctgagggcagctgtcagccagcaaggggagcaactgcagacagagagggagagggggcgcactgcagcggaggacaacgttcgcctcacttgcttggtagctgagctccagaagcagtgggaggtcacccaggccacccagaacactgtgaaggagctgcagacatgcctgcaggccctggagctaggagcagcagagaaggaggaggactaccacacagccctgcggcggctggagtccatgctgcagcccttggcacaggagcttgaggccacacgggactcactggacaagaaaaaccagcatttagccagcttcccaggctggctagccatggctcagcagaaggcagatacggcatcagacacaaagggccggcaagaacctattcccagtgatgcggcccaggagatgcaggagctaggggagaagcttcaagccctagaaagggagagaaccaaggtcgaggaggtcaacagacagcagagtgcccaactggaacagctggtcaaggagcttcagctgaaagaggatgcccgggccagcctggagcgcctggtgaaggagatggccccactccaggaggagttgtctggggacccagaaggaactcgaaaaagccacaacaaaaatccaagagtattacaacaaactctgccaggaggtgacaaatcgtgagaggaatgaccagaagatgcttgctgacctggatgacctcaacagaaccaagaagtatctcgaggagcggctgatagagctgctcagggacaaggatgctctctggcagaagtcagatgccctggaattccagcagaagctcagtgctgaggagagatggctcggagacacagaggcaaaccactgcctcgactgtaagcgggagttcagctggatggtgcggcggcaccactgcaggatatgtggccgcatcttctgttactactgctgcaacaactacgtcctgagcaagcacggtggcaaaaaggagcgctgctgccgagcctgtttccagaagctcagtgaaggccctggctcccctgatagcagtggctcaggcactagccagggagagcccagccctgcactgtcaccagcctcacctgggccccaggccacaggaggccaaggagcaaatacagactacaggccaccggacgacgctgtgtttgatatcatcacagatgaggaattgtgccagatacaggagtccggctcctctttgcctgaaacacccactgaaactgattctcttgacccaaatgcggctgaacaggatactacatcaacctcgctaacgcctgaggacactgaagacatgcccgtggggcaggattcggaaatctgcctgctgaagtctggagaactgatgatcaaagtacccctcacagtggatgagatcgccagcttcggggagggtagcagggagctgtttgtgaggtccagcacctacagcctgatccccatcactgtggccgaggcaggcctcaccatcagctgggtcttctcctctgaccccaagagcatctccttcagtgtggtcttccaggaggccgaggacacaccgctggatcagtgtaaggtcctcattcccacgacccgatgcaactcccacaaggagaacatccagggccagctcaaggttcgcacacccggcatctacatgctcatcttcgacaataccttctcaaggtttgtctctaaaaaggtattttatcacttgacggttgatcggcctgtgatctacgatggaagtgatttcctgtagcttcagcacctcagtaacttcacttcatccacaggaaacactgctcttcctcacctgtcacataaagcatttttttaaaaagtcagctgctccaaaatcatcaactcagcccctgggctgcccctcagaggcggtgtctggggaggactttgtgctcagcactctgcaccggccactcttagcccccgaggcgttgaagggctcaggcaatgtttccattaagtagagactcagctgttgtcacacccaaagggatgctctgccaaaggtttaaacacccaggagaccatcagcctctcctgggagcacagttgactacaggcctcttgtggagagtttcacgggcaggggtgattccaacttctgcctgtggagagattttctgccctgccccaccagggccctgcatgttggagactgagctgggtgcactggccatnccctgtgaatcctcgggctgtgacgccctcaggtactcctgggaaaaggaggtacacagccatcatgcgagtcggtgccaggggaccccccggagatcctgaccagctcctccagtcatgctcttgtccctcactgccccagtaagctggaggctgctccagaactcagcagtgttggaggggcctctaagctgcactctctttctggcccttttgtctggctgattctgtcctcaaataaagcccttcactcagccagacctctccacagctcaaagcattgccctaagaatcagaagtaaagataatccaagagcaaaacccactgtacttggggcctgcaatggctgtgtgtacactacatctaatgcccaaatgccagccagtgtggatgttgtgaccacagagcaggattgtgcattggctttagagctactcctcagctgatggcccacttttgtttatataaataagagcttctgccccacctgcagacatgtttactaatgatcatagccaggattagaaccactttcaaacattggggccttcttaacaaaagtctttgataacttaagaaccaaagtaacagagtaaacagaggcatgatggatccctgggccccactcccctcctgacaggttccccaacagcccatttgcccacttcccactgctcagcccacaccagacctccaggagacatccccccttgaggcagagagatcctgttccctattcccagacaagaattatttaatcttccctgttctctgtggtccttttcttccccaacaacagatagctcaccttggacagctcttcgtcccttgttcatggaaccagctgcctgcagtcaggccccaggttcttccatgggtgaacagagcatctgacaaaaggtcccagtttggccaggggtgagggagagagcaccagacaggctatccgagaatctgagagctgggcccggcaattcctccagctacccttgtgacctaagtccagtcacacatttcccaaagtttctctttgtcataaccctggtctggctggttttgagggcttgagaatgggtcagggactccaggccaagtccaacagagaccccaaacccaccacacaccagcagccacaacctcaccaccaacaaagaggacttttgtggggccacaagtaagaggtcatttctggaatggactcagacctttaaacaggagagttgagcacttccagtcagtttttaagcaaggcatggggaacagggaatagaacctttcaaagaggttgcccagagaaaagctgggcctcttgcattcggcttccttggagcagcctcttctggcagaaagccatcaggtgctcaatcatcttctcctggccaaggctctgaccatgcttagtactggaatagaggtggccaggcccccagcgactcttcttggcctgatgtttgtcctcacaggcatgccacgtggcctgagatgattcagaacaaatcatgctaactttgaatccatccagccacttgcaaatgataatcagaagtcagcttgttcactgttagaaagaaactaacaaaagagaacccagagcaatctagaatctttgagtgcttggctttccaaggatactgcggagactctggccaagctgatgaccttctgaagtgtcactggcaccatatgcaacaagaaccaccattcactgagtagctaatgggtttggggcctgggacattccatctgaggtccttcctgaacatgtcactccacagcagaggaccggttgcagcttacccagaaccactcctccaggagagctggatgttttgcgtgcaacaccttgagcactgactgctattgttcaaaaaaagcctttgctgcattcggaggactgccccgtgccctgaggtgacttcctaactatgtggtttcattagcgaatttatttttgtgctgggtggacatttgtattttgttaggttgctgtttaagctcaagtttgctgtgctctctgcagctacaaaacatcttggcatatttaagagtggcttttataaatagctttattctgatattaatcagattcccaactttactgagaattaaggactggggtactttaaagaaatgcaaatagcaattgaagaaccactgctgcaggtggtagccctggctagactgaattacactagaaatcagccagaaggaagcgtccttgggatcccagatcactcttttttttttttttttttaaaaggggcagccccttgatggctcatctctctgaataacagttacgtcttcatatcgataccagatgccttcttcatcatgccactgaagccactcaccaccttcaagaacatgccaacctctgtcagattcacttacccacaaacaaggaggcacgtttggcacaaagtgttgtcctccaggtccaagtggactctacagagtgcttgacctcaacacactggattccaggtggactggaccaagagcaggcaaagacacgggaactgaaaaactccacagggtttggagaatagaaatgaaaagccacgtcatataactcaagaataaatggtgttttggaaattttaaaattatcatcgaaggtggtgaaactatttcaggcccaaatgaaaggaaatcgccagttggggatgaaatcacagagcctgtgttttatgatatggttggatgtccactgatgaaattttaaaggagtttcatttttaaaagtgcgcatgattctacatatgagaattctttaggccaagaaactgtccttggctcagaggtgttgggaattaaagcagagagaagccattcgtgatgcttagaaccaaggatggtcatgtacacaaagaccatcgagacggccattcttgtttacaaaacacttaccaagaaagcactttgtaggggaactttagtaagttcttctcatttcattatgtttcttccaaggaaacaggagagactgaattaataattctctctttcctcttaagcacttttaaaataataaagtacatcttgaaatttggggaggcatctctgatttaaaaaaagaaaaaggctgcttgatgtatgttatgcagagacactctgcctctggtggctgcagagcaatacccaagcctcatttggaaggctcaacatttggaattgcactttaattgattaatcctcaattcatgtggccttacgggatggtgggtctgggaccccaattcattcttatctgccaaagaattatctagaagcacatcaaataccagcaccccacctgcacaatgggggtggaaaacttttgtatccctaagcatattattttatagtgtctgccatgccatgtggaaatactttatttttaacctcaggatttaaataaagtaaacactatgacatttaaaaaaaaaac

SEQ ID NO: 307666 - DNA, 7094 bp, Homo sapiens
  misc_feature (3660)..(3660): n is a, c, g, or t
tacagagggatcataaccaaagggctcagtgatcggcgaaaagacccgttgaggagatgcccaactggaacagctggtcaaggagcttcagctgaaagaggatgcccgggccagcctggagcgcctggtgaaggagatggccccactccaggaggagttgtctgggaagggacaggaggcagaccagctctggcgacggctgcaggagttgctggcccacacgagctcctgggaggaggagctagcagagttgaggcgggagaaaaaacagcaacaggaggagaaggagctgctggagcaggaggtcaggtctctgacccggcagctgcagttcctggagacccagctggcacaggtgagccaacatgtgagtgacctggaggagcagaagaagcagctcattcaggacaaagaccacctcagccagcaggtgggtatgctcgagcggcttgctgggccgcctggcccagaactgccagtggcaggtgagaagaatgaggccctggtccctgtgaactccagtctgcaagaggcctgggggaagccagaggaggagcagaggggcctgcaggaggcacagttagacgataccaaggtgcaagagggcagccaggaggaagagctccggcaggccaacagggagctggagaaggagctacagaatgtggtcgggcgtaaccagctcctggagggcaagctgcaagccctgcaggccgattaccaggctttgcagcagcgggaatcagccatccagggctccttggcctccctggaggccgagcaggccagcatccggcacttgggtgaccagatggaggcgagcttgctggctgtaaggaaggccaaggaggccatgaaagcccagatggcagagaaggaggccattctacagagcaaggagggcgagtgtcagcagctgcgggaggaggtggagcagtgccagcaactggcagaagcccggcacagagagcttagggctctcgagagccagtgccagcagcagacccagctgattgaggtcctcacagcagagaaaggccaacagggagttggcccacccactgacaatgaagcccgtgagctggctgcccagctagccctgtctcaggcgcagctggaagtccatcagggggaggtccaacggctgcaggctcaggtggtggacctccaggccaagatgcgggcagccctggatgaccaggacaaggtgcagagccagctaagcatggctgaggccgtcctgagggagcacaaaacccttgtgcagcagctgaaggagcagaatgaagcccttaacagagcccatgtccaggagctgctgcaatgctcggagcgtgaaggggcactgcaggaggagagggccgatgaggcccagcagagggaggaggagctgcgggccctgcaggaggagctgtcccaggccaaatgcagctccgaggaagcacagctggagcacgctgagctgcaagagcagctgcaccgggccaacacagacacagctgagctgggcatccaggtttgcgcactgaccgtggaaaaggagcgagtggaggaggcactggcctgtgctgtccaggagctccaggacgccaaagaggcagcctcaagggagcgagagggcctggagcgccaagtagctgggctgcagcaagagaaggagagcttgcaggagaagctgaaggcggccaaggcagcagccggctcactgcctggcctgcaggcccagctcgcccaggcagagcagcgggcccagagcctccaagaggctgcacaccaggagctcaacaccctcaagttccagctgagtgctgaaatcatggactaccagagcagacttaagaatgctggtgaagagtgcaagagcctcaggggccagcttgaggagcaaggccggcagctgcaggctgctgaggaagctgtggagaagctgaaggccacccaagcagacatgggagagaagctgagctgcactagcaaccatcttgcagagtgccaggcggccatgctgaggaaggacaaggagggggctgccctgcgtgaagacctagaaaggacccagaaggaactcgaaaaagccacaacaaaaatccaagagtattacaacaaactctgccaggaggtgacaaatcgtgagaggaatgaccagaagatgcttgctgacctggatgacctcaacagaaccaagaagtatctcgaggagcggctgatagagctgctcagggacaaggatgctctctggcagaagtcagatgccctggaattccagcagaagctcagtgctgaggagagatggctcggagacacagaggcaaaccactgcctcgactgtaagcgggagttcagctggatggtgcggcggcaccactgcaggatatgtggccgcatcttctgttactactgctgcaacaactacgtcctgagcaagcacggtggcaaaaaggagcgctgctgccgagcctgtttccagaagctcagtgaaggccctggctcccctgatagcagtggctcaggcactagccagggagagcccagccctgcactgtcaccagcctcacctgggccccaggccacaggaggccaaggagcaaatacagactacaggccaccggacgacgctgtgtttgatatcatcacagatgaggaattgtgccagatacaggagtccggctcctctttgcctgaaacacccactgaaactgattctcttgacccaaatgcggctgaacaggatactacatcaacctcgctaacgcctgaggacactgaagacatgcccgtggggcaggattcggaaatctgcctgctgaagtctggagaactgatgatcaaagtacccctcacagtggatgagatcgccagcttcggggagggtagcagggagctgtttgtgaggtccagcacctacagcctgatccccatcactgtggccgaggcaggcctcaccatcagctgggtcttctcctctgaccccaagagcatctccttcagtgtggtcttccaggaggccgaggacacaccgctggatcagtgtaaggtcctcattcccacgacccgatgcaactcccacaaggagaacatccagggccagctcaaggttcgcacacccggcatctacatgctcatcttcgacaataccttctcaaggtttgtctctaaaaaggtattttatcacttgacggttgatcggcctgtgatctacgatggaagtgatttcctgtagcttcagcacctcagtaacttcacttcatccacaggaaacactgctcttcctcacctgtcacataaagcatttttttaaaaagtcagctgctccaaaatcatcaactcagcccctgggctgcccctcagaggcggtgtctggggaggactttgtgctcagcactctgcaccggccactcttagcccccgaggcgttgaagggctcaggcaatgtttccattaagtagagactcagctgttgtcacacccaaagggatgctctgccaaaggtttaaacacccaggagaccatcagcctctcctgggagcacagttgactacaggcctcttgtggagagtttcacgggcaggggtgattccaacttctgcctgtggagagattttctgccctgccccaccagggccctgcatgttggagactgagctgggtgcactggccatnccctgtgaatcctcgggctgtgacgccctcaggtactcctgggaaaaggaggtacacagccatcatgcgagtcggtgccaggggaccccccggagatcctgaccagctcctccagtcatgctcttgtccctcactgccccagtaagctggaggctgctccagaactcagcagtgttggaggggcctctaagctgcactctctttctggcccttttgtctggctgattctgtcctcaaataaagcccttcactcagccagacctctccacagctcaaagcattgccctaagaatcagaagtaaagataatccaagagcaaaacccactgtacttggggcctgcaatggctgtgtgtacactacatctaatgcccaaatgccagccagtgtggatgttgtgaccacagagcaggattgtgcattggctttagagctactcctcagctgatggcccacttttgtttatataaataagagcttctgccccacctgcagacatgtttactaatgatcatagccaggattagaaccactttcaaacattggggccttcttaacaaaagtctttgataacttaagaaccaaagtaacagagtaaacagaggcatgatggatccctgggccccactcccctcctgacaggttccccaacagcccatttgcccacttcccactgctcagcccacaccagacctccaggagacatccccccttgaggcagagagatcctgttccctattcccagacaagaattatttaatcttccctgttctctgtggtccttttcttccccaacaacagatagctcaccttggacagctcttcgtcccttgttcatggaaccagctgcctgcagtcaggccccaggttcttccatgggtgaacagagcatctgacaaaaggtcccagtttggccaggggtgagggagagagcaccagacaggctatccgagaatctgagagctgggcccggcaattcctccagctacccttgtgacctaagtccagtcacacatttcccaaagtttctctttgtcataaccctggtctggctggttttgagggcttgagaatgggtcagggactccaggccaagtccaacagagaccccaaacccaccacacaccagcagccacaacctcaccaccaacaaagaggacttttgtggggccacaagtaagaggtcatttctggaatggactcagacctttaaacaggagagttgagcacttccagtcagtttttaagcaaggcatggggaacagggaatagaacctttcaaagaggttgcccagagaaaagctgggcctcttgcattcggcttccttggagcagcctcttctggcagaaagccatcaggtgctcaatcatcttctcctggccaaggctctgaccatgcttagtactggaatagaggtggccaggcccccagcgactcttcttggcctgatgtttgtcctcacaggcatgccacgtggcctgagatgattcagaacaaatcatgctaactttgaatccatccagccacttgcaaatgataatcagaagtcagcttgttcactgttagaaagaaactaacaaaagagaacccagagcaatctagaatctttgagtgcttggctttccaaggatactgcggagactctggccaagctgatgaccttctgaagtgtcactggcaccatatgcaacaagaaccaccattcactgagtagctaatgggtttggggcctgggacattccatctgaggtccttcctgaacatgtcactccacagcagaggaccggttgcagcttacccagaaccactcctccaggagagctggatgttttgcgtgcaacaccttgagcactgactgctattgttcaaaaaaagcctttgctgcattcggaggactgccccgtgccctgaggtgacttcctaactatgtggtttcattagcgaatttatttttgtgctgggtggacatttgtattttgttaggttgctgtttaagctcaagtttgctgtgctctctgcagctacaaaacatcttggcatatttaagagtggcttttataaatagctttattctgatattaatcagattcccaactttactgagaattaaggactggggtactttaaagaaatgcaaatagcaattgaagaaccactgctgcaggtggtagccctggctagactgaattacactagaaatcagccagaaggaagcgtccttgggatcccagatcactcttttttttttttttttttaaaaggggcagccccttgatggctcatctctctgaataacagttacgtcttcatatcgataccagatgccttcttcatcatgccactgaagccactcaccaccttcaagaacatgccaacctctgtcagattcacttacccacaaacaaggaggcacgtttggcacaaagtgttgtcctccaggtccaagtggactctacagagtgcttgacctcaacacactggattccaggtggactggaccaagagcaggcaaagacacgggaactgaaaaactccacagggtttggagaatagaaatgaaaagccacgtcatataactcaagaataaatggtgttttggaaattttaaaattatcatcgaaggtggtgaaactatttcaggcccaaatgaaaggaaatcgccagttggggatgaaatcacagagcctgtgttttatgatatggttggatgtccactgatgaaattttaaaggagtttcatttttaaaagtgcgcatgattctacatatgagaattctttaggccaagaaactgtccttggctcagaggtgttgggaattaaagcagagagaagccattcgtgatgcttagaaccaaggatggtcatgtacacaaagaccatcgagacggccattcttgtttacaaaacacttaccaagaaagcactttgtaggggaactttagtaagttcttctcatttcattatgtttcttccaaggaaacaggagagactgaattaataattctctctttcctcttaagcacttttaaaataataaagtacatcttgaaatttggggaggcatctctgatttaaaaaaagaaaaaggctgcttgatgtatgttatgcagagacactctgcctctggtggctgcagagcaatacccaagcctcatttggaaggctcaacatttggaattgcactttaattgattaatcctcaattcatgtggccttacgggatggtgggtctgggaccccaattcattcttatctgccaaagaattatctagaagcacatcaaataccagcaccccacctgcacaatgggggtggaaaacttttgtatccctaagcatattattttatagtgtctgccatgccatgtggaaatactttatttttaacctcaggatttaaataaagtaaacactatgacatttaaaaaaaaaac

SEQ ID NO: 307667 - DNA, 6608 bp, Homo sapiens
  misc_feature (3174)..(3174): n is a, c, g, or t
ccggttcagagtgctccagctgtgcttcctcggagctgcatttggcctgggacagctccttctccagctccctgtgggcctgcaggaggcacagttagacgataccaaggtgcaagagggcagccaggaggaagagctccggcaggccaacagggagctggagaaggagctacagaatgtggtcgggcgtaaccagctcctggagggcaagctgcaagccctgcaggccgattaccaggctttgcagcagcgggaatcagccatccagggctccttggcctccctggaggccgagcaggccagcatccggcacttgggtgaccagatggaggcgagcttgctggctgtaaggaaggccaaggaggccatgaaagcccagatggcagagaaggaggccattctacagagcaaggagggcgagtgtcagcagctgcgggaggaggtggagcagtgccagcaactggcagaagcccggcacagagagcttagggctctcgagagccagtgccagcagcagacccagctgattgaggtcctcacagcagagaaaggccaacagggagttggcccacccactgacaatgaagcccgtgagctggctgcccagctagccctgtctcaggcgcagctggaagtccatcagggggaggtccaacggctgcaggctcaggtggtggacctccaggccaagatgcgggcagccctggatgaccaggacaaggtgcagagccagctaagcatggctgaggccgtcctgagggagcacaaaacccttgtgcagcagctgaaggagcagaatgaagcccttaacagagcccatgtccaggagctgctgcaatgctcggagcgtgaaggggcactgcaggaggagagggccgatgaggcccagcagagggaggaggagctgcgggccctgcaggaggagctgtcccaggccaaatgcagctccgaggaagcacagctggagcacgctgagctgcaagagcagctgcaccgggccaacacagacacagctgagctgggcatccaggtttgcgcactgaccgtggaaaaggagcgagtggaggaggcactggcctgtgctgtccaggagctccaggacgccaaagaggcagcctcaagggagcgagagggcctggagcgccaagtagctgggctgcagcaagagaaggagagcttgcaggagaagctgaaggcggccaaggcagcagccggctcactgcctggcctgcaggcccagctcgcccaggcagagcagcgggcccagagcctccaagaggctgcacaccaggagctcaacaccctcaagttccagctgagtgctgaaatcatggactaccagagcagacttaagaatgctggtgaagagtgcaagagcctcaggggccagcttgaggagcaaggccggcagctgcaggctgctgaggaagctgtggagaagctgaaggccacccaagcagacatgggagagaagctgagctgcactagcaaccatcttgcagagtgccaggcggccatgctgaggaaggacaaggagggggctgccctgcgtgaagacctagaaaggacccagaaggaactcgaaaaagccacaacaaaaatccaagagtattacaacaaactctgccaggaggtgacaaatcgtgagaggaatgaccagaagatgcttgctgacctggatgacctcaacagaaccaagaagtatctcgaggagcggctgatagagctgctcagggacaaggatgctctctggcagaagtcagatgccctggaattccagcagaagctcagtgctgaggagagatggctcggagacacagaggcaaaccactgcctcgactgtaagcgggagttcagctggatggtgcggcggcaccactgcaggatatgtggccgcatcttctgttactactgctgcaacaactacgtcctgagcaagcacggtggcaaaaaggagcgctgctgccgagcctgtttccagaagctcagtgaaggccctggctcccctgatagcagtggctcaggcactagccagggagagcccagccctgcactgtcaccagcctcacctgggccccaggccacaggaggccaaggagcaaatacagactacaggccaccggacgacgctgtgtttgatatcatcacagatgaggaattgtgccagatacaggagtccggctcctctttgcctgaaacacccactgaaactgattctcttgacccaaatgcggctgaacaggatactacatcaacctcgctaacgcctgaggacactgaagacatgcccgtggggcaggattcggaaatctgcctgctgaagtctggagaactgatgatcaaagtacccctcacagtggatgagatcgccagcttcggggagggtagcagggagctgtttgtgaggtccagcacctacagcctgatccccatcactgtggccgaggcaggcctcaccatcagctgggtcttctcctctgaccccaagagcatctccttcagtgtggtcttccaggaggccgaggacacaccgctggatcagtgtaaggtcctcattcccacgacccgatgcaactcccacaaggagaacatccagggccagctcaaggttcgcacacccggcatctacatgctcatcttcgacaataccttctcaaggtttgtctctaaaaaggtattttatcacttgacggttgatcggcctgtgatctacgatggaagtgatttcctgtagcttcagcacctcagtaacttcacttcatccacaggaaacactgctcttcctcacctgtcacataaagcatttttttaaaaagtcagctgctccaaaatcatcaactcagcccctgggctgcccctcagaggcggtgtctggggaggactttgtgctcagcactctgcaccggccactcttagcccccgaggcgttgaagggctcaggcaatgtttccattaagtagagactcagctgttgtcacacccaaagggatgctctgccaaaggtttaaacacccaggagaccatcagcctctcctgggagcacagttgactacaggcctcttgtggagagtttcacgggcaggggtgattccaacttctgcctgtggagagattttctgccctgccccaccagggccctgcatgttggagactgagctgggtgcactggccatnccctgtgaatcctcgggctgtgacgccctcaggtactcctgggaaaaggaggtacacagccatcatgcgagtcggtgccaggggaccccccggagatcctgaccagctcctccagtcatgctcttgtccctcactgccccagtaagctggaggctgctccagaactcagcagtgttggaggggcctctaagctgcactctctttctggcccttttgtctggctgattctgtcctcaaataaagcccttcactcagccagacctctccacagctcaaagcattgccctaagaatcagaagtaaagataatccaagagcaaaacccactgtacttggggcctgcaatggctgtgtgtacactacatctaatgcccaaatgccagccagtgtggatgttgtgaccacagagcaggattgtgcattggctttagagctactcctcagctgatggcccacttttgtttatataaataagagcttctgccccacctgcagacatgtttactaatgatcatagccaggattagaaccactttcaaacattggggccttcttaacaaaagtctttgataacttaagaaccaaagtaacagagtaaacagaggcatgatggatccctgggccccactcccctcctgacaggttccccaacagcccatttgcccacttcccactgctcagcccacaccagacctccaggagacatccccccttgaggcagagagatcctgttccctattcccagacaagaattatttaatcttccctgttctctgtggtccttttcttccccaacaacagatagctcaccttggacagctcttcgtcccttgttcatggaaccagctgcctgcagtcaggccccaggttcttccatgggtgaacagagcatctgacaaaaggtcccagtttggccaggggtgagggagagagcaccagacaggctatccgagaatctgagagctgggcccggcaattcctccagctacccttgtgacctaagtccagtcacacatttcccaaagtttctctttgtcataaccctggtctggctggttttgagggcttgagaatgggtcagggactccaggccaagtccaacagagaccccaaacccaccacacaccagcagccacaacctcaccaccaacaaagaggacttttgtggggccacaagtaagaggtcatttctggaatggactcagacctttaaacaggagagttgagcacttccagtcagtttttaagcaaggcatggggaacagggaatagaacctttcaaagaggttgcccagagaaaagctgggcctcttgcattcggcttccttggagcagcctcttctggcagaaagccatcaggtgctcaatcatcttctcctggccaaggctctgaccatgcttagtactggaatagaggtggccaggcccccagcgactcttcttggcctgatgtttgtcctcacaggcatgccacgtggcctgagatgattcagaacaaatcatgctaactttgaatccatccagccacttgcaaatgataatcagaagtcagcttgttcactgttagaaagaaactaacaaaagagaacccagagcaatctagaatctttgagtgcttggctttccaaggatactgcggagactctggccaagctgatgaccttctgaagtgtcactggcaccatatgcaacaagaaccaccattcactgagtagctaatgggtttggggcctgggacattccatctgaggtccttcctgaacatgtcactccacagcagaggaccggttgcagcttacccagaaccactcctccaggagagctggatgttttgcgtgcaacaccttgagcactgactgctattgttcaaaaaaagcctttgctgcattcggaggactgccccgtgccctgaggtgacttcctaactatgtggtttcattagcgaatttatttttgtgctgggtggacatttgtattttgttaggttgctgtttaagctcaagtttgctgtgctctctgcagctacaaaacatcttggcatatttaagagtggcttttataaatagctttattctgatattaatcagattcccaactttactgagaattaaggactggggtactttaaagaaatgcaaatagcaattgaagaaccactgctgcaggtggtagccctggctagactgaattacactagaaatcagccagaaggaagcgtccttgggatcccagatcactcttttttttttttttttttaaaaggggcagccccttgatggctcatctctctgaataacagttacgtcttcatatcgataccagatgccttcttcatcatgccactgaagccactcaccaccttcaagaacatgccaacctctgtcagattcacttacccacaaacaaggaggcacgtttggcacaaagtgttgtcctccaggtccaagtggactctacagagtgcttgacctcaacacactggattccaggtggactggaccaagagcaggcaaagacacgggaactgaaaaactccacagggtttggagaatagaaatgaaaagccacgtcatataactcaagaataaatggtgttttggaaattttaaaattatcatcgaaggtggtgaaactatttcaggcccaaatgaaaggaaatcgccagttggggatgaaatcacagagcctgtgttttatgatatggttggatgtccactgatgaaattttaaaggagtttcatttttaaaagtgcgcatgattctacatatgagaattctttaggccaagaaactgtccttggctcagaggtgttgggaattaaagcagagagaagccattcgtgatgcttagaaccaaggatggtcatgtacacaaagaccatcgagacggccattcttgtttacaaaacacttaccaagaaagcactttgtaggggaactttagtaagttcttctcatttcattatgtttcttccaaggaaacaggagagactgaattaataattctctctttcctcttaagcacttttaaaataataaagtacatcttgaaatttggggaggcatctctgatttaaaaaaagaaaaaggctgcttgatgtatgttatgcagagacactctgcctctggtggctgcagagcaatacccaagcctcatttggaaggctcaacatttggaattgcactttaattgattaatcctcaattcatgtggccttacgggatggtgggtctgggaccccaattcattcttatctgccaaagaattatctagaagcacatcaaataccagcaccccacctgcacaatgggggtggaaaacttttgtatccctaagcatattattttatagtgtctgccatgccatgtggaaatactttatttttaacctcaggatttaaataaagtaaacactatgacatttaaaaaaaaaac

SEQ ID NO: 307668 - DNA, 2477 bp, Homo sapiens
cgtcatggccgtcagcaccgcgttcccgtcctcttccgcttggccccagaaagtttcggttctgcccggcggtggacccacgagcgcgtgccaccatggagtctgaccactgctgagcagacagccaccgagggccgaaattctgagccttcctctggacccaggcaggagacatacagacaagaaaggcaaactcaccatggcctccaccaatgcagagagccagctccagagaatcatccgagacttgcaagatgctgtgacagaactaagcaaagaatttcaggaagcaggggaacccatcacggatgacagcaccagcttgcataaattttcttataaacttgagtatctcctgcaatttgatcagaaagagaaggccaccctcctgggcaacaagaaggactactgggattacttctgtgcctgcctggccaaggtgaaaggagccaatgatgggatccgatttgtcaagtctatctcagagctccgaacatccttggggaaaggaagagcatttattcgctactccttggtgcaccagaggttggcagacaccttacagcagtgcttcatgaacaccaaagtgaccagtgactggtactatgcaagaagcccctttctgcagccaaagctgagctcggacattgtgggccaactctatgagctgactgaggttcagtttgacctggcgtcgaggggctttgacttggatgctgcctggccaacatttgccaggaggacgctgaccactggctcttctgcttacctgtggaaaccccctagccgcagctccagcatgagcagcttggtgagcagctacctgcagactcaagagatggtgtccaactttgacctgaacagccccctaaacaacgaggcattggagggctttgatgagatgcgactagagctggaccagttggaggtgcgggagaagcagctacaggagcgcatgcagcagctggacagagagaaccaggagctgagggcagctgtcagccagcaaggggagcaactgcagacagagagggagagggggcgcactgcagcggaggacaacgttcgcctcacttgcttggtagctgagctccagaagcagtgggaggtcacccaggccacccagaacactgtgaaggagctgcagacatgcctgcaggccctggagctaggagcagcagagaaggaggaggactaccacacagccctgcggcggctggagtccatgctgcagcccttggcacaggagcttgaggccacacgggactcactggacaagaaaaaccagcatttagccagcttcccaggctggctagccatgctcatctctctgaataacagttacgtcttcatatcgataccagatgccttcttcatcatgccactgaagccactcaccaccttcaagaacatgccaacctctgtcagattcacttacccacaaacaaggaggcacgtttggcacaaagtgttgtcctccaggtccaagtggactctacagagtgcttgacctcaacacactggattccaggtggactggaccaagagcaggcaaagacacgggaactgaaaaactccacagggtttggagaatagaaatgaaaagccacgtcatataactcaagaataaatggtgttttggaaattttaaaattatcatcgaaggtggtgaaactatttcaggcccaaatgaaaggaaatcgccagttggggatgaaatcacagagcctgtgttttatgatatggttggatgtccactgatgaaattttaaaggagtttcatttttaaaagtgcgcatgattctacatatgagaattctttaggccaagaaactgtccttggctcagaggtgttgggaattaaagcagagagaagccattcgtgatgcttagaaccaaggatggtcatgtacacaaagaccatcgagacggccattcttgtttacaaaacacttaccaagaaagcactttgtaggggaactttagtaagttcttctcatttcattatgtttcttccaaggaaacaggagagactgaattaataattctctctttcctcttaagcacttttaaaataataaagtacatcttgaaatttggggaggcatctctgatttaaaaaaagaaaaaggctgcttgatgtatgttatgcagagacactctgcctctggtggctgcagagcaatacccaagcctcatttggaaggctcaacatttggaattgcactttaattgattaatcctcaattcatgtggccttacgggatggtgggtctgggaccccaattcattcttatctgccaaagaattatctagaagcacatcaaataccagcaccccacctgcacaatgggggtggaaaacttttgtatccctaagcatattattttatagtgtctgccatgccatgtggaaatactttatttttaacctcaggatttaaataaagtaaacactatgacatttaaaaaaaaaac

SEQ ID NO: 307669 - DNA, 6540 bp, Homo sapiens
  misc_feature (5076)..(5076): n is a, c, g, or t
cgtcatggccgtcagcaccgcgttcccgtcctcttccgcttggccccagaaagtttcggttctgcccggcggtggacccacgagcgcgtgccaccatggagtctgaccactgctgagcagacagccaccgagggccgaaattctgagccttcctctggacccaggcaggagacatacagacaagaaaggcaaactcaccatggcctccaccaatgcagagagccagctccagagaatcatccgagacttgcaagatgctgtgacagaactaagcaaagaatttcaggaagcaggggaacccatcacggatgacagcaccagcttgcataaattttcttataaacttgagtatctcctgcaatttgatcagaaagagaaggccaccctcctgggcaacaagaaggactactgggattacttctgtgcctgcctggccaaggtgaaaggagccaatgatgggatccgatttgtcaagtctatctcagagctccgaacatccttggggaaaggaagagcatttattcgctactccttggtgcaccagaggttggcagacaccttacagcagtgcttcatgaacaccaaagtgaccagtgactggtactatgcaagaagcccctttctgcagccaaagctgagctcggacattgtgggccaactctatgagctgactgaggttcagtttgacctggcgtcgaggggctttgacttggatgctgcctggccaacatttgccaggaggacgctgaccactggctcttctgcttacctgtggaaaccccctagccgcagctccagcatgagcagcttggtgagcagctacctgcagactcaagagatggtgtccaactttgacctgaacagccccctaaacaacgaggcattggagggctttgatgagatgcgactagagctggaccagttggaggtgcgggagaagcagctacaggagcgcatgcagcagctggacagagagaaccaggagctgagggcagctgtcagccagcaaggggagcaactgcagacagagagggagagggggcgcactgcagcggaggacaacgttcgcctcacttgcttggtagctgagctccagaagcagtgggaggtcacccaggccacccagaacactgtgaaggagctgcagacatgcctgcaggccctggagctaggagcagcagagaaggaggaggactaccacacagccctgcggcggctggagtccatgctgcagcccttggcacaggagcttgaggccacacgggactcactggacaagaaaaaccagcatttagccagcttcccaggctggctagccatggctcagcagaaggcagatacggcatcagacacaaagggccggcaagaacctattcccagtgatgcggcccaggagatgcaggagctaggggagaagcttcaagccctagaaagggagagaaccaaggtcgaggaggtcaacagacagcagagtgcccaactggaacagctggtcaaggagcttcagctgaaagaggatgcccgggccagcctggagcgcctggtgaaggagatggccccactccaggaggagttgtctgggaagggacaggaggcagaccagctctggcgacggctgcaggagttgctggcccacacgagctcctgggaggaggagctagcagagttgaggcgggagaaaaaacagcaacaggaggagaaggagctgctggagcaggaggtcaggtctctgacccggcagctgcagttcctggagacccagctggcacaggtgagccaacatgtgagtgacctggaggagcagaagaagcagctcattcaggacaaagaccacctcagccagcaggtgggtatgctcgagcggcttgctgggccgcctggcccagaactgccagtggcaggtgagaagaatgaggccctggtccctgtgaactccagtctgcaagaggcctgggggaagccagaggaggagcagaggggcctgcaggaggcacagttagacgataccaaggtgcaagagggcagccaggaggaagagctccggcaggccaacagggagctggagaaggagctacagaatgtggtcgggcgtaaccagctcctggagggcaagctgcaagccctgcaggccgattaccaggctttgcagcagcgggaatcagccatccagggctccttggcctccctggaggccgagcaggccagcatccggcacttgggtgaccagatggaggcgagcttgctggctgtaaggaaggccaaggaggccatgaaagcccagatggcagagaaggaggccattctacagagcaaggagggcgagtgtcagcagctgcgggaggaggtggagcagtgccagcaactggcagaagcccggcacagagagcttagggctctcgagagccagtgccagcagcagacccagctgattgaggtcctcacagcagagaaaggccaacagggagttggcccacccactgacaatgaagcccgtgagctggctgcccagctagccctgtctcaggcgcagctggaagtccatcagggggaggtccaacggctgcaggctcaggtggtggacctccaggccaagatgcgggcagccctggatgaccaggacaaggtgcagagccagctaagcatggctgaggccgtcctgagggagcacaaaacccttgtgcagcagctgaaggagcagaatgaagcccttaacagagcccatgtccaggagctgctgcaatgctcggagcgtgaaggggcactgcaggaggagagggccgatgaggcccagcagagggaggaggagctgcgggccctgcaggaggagctgtcccaggccaaatgcagctccgaggaagcacagctggagcacgctgagctgcaagagcagctgcaccgggccaacacagacacagctgagctgggcatccaggtttgcgcactgaccgtggaaaaggagcgagtggaggaggcactggcctgtgctgtccaggagctccaggacgccaaagaggcagcctcaagggagcgagagggcctggagcgccaagtagctgggctgcagcaagagaaggagagcttgcaggagaagctgaaggcggccaaggcagcagccggctcactgcctggcctgcaggcccagctcgcccaggcagagcagcgggcccagagcctccaagaggctgcacaccaggagctcaacaccctcaagttccagctgagtgctgaaatcatggactaccagagcagacttaagaatgctggtgaagagtgcaagagcctcaggggccagcttgaggagcaaggccggcagctgcaggctgctgaggaagctgtggagaagctgaaggccacccaagcagacatgggagagaagctgagctgcactagcaaccatcttgcagagtgccaggcggccatgctgaggaaggacaaggagggggctgccctgcgtgaagacctagaaaggacccagaaggaactcgaaaaagccacaacaaaaatccaagagtattacaacaaactctgccaggaggtgacaaatcgtgagaggaatgaccagaagatgcttgctgacctggatgacctcaacagaaccaagaagtatctcgaggagcggctgatagagctgctcagggacaaggatgctctctggcagaagtcagatgccctggaattccagcagaagctcagtgctgaggagagatggctcggagacacagaggcaaaccactgcctcgactgtaagcgggagttcagctggatggtgcggcggcaccactgcaggatatgtggccgcatcttctgttactactgctgcaacaactacgtcctgagcaagcacggtggcaaaaaggagcgctgctgccgagcctgtttccagaagctcagtgaaggccctggctcccctgatagcagtggctcaggcactagccagggagagcccagccctgcactgtcaccagcctcacctgggccccaggccacaggaggccaaggagcaaatacagactacaggccaccggacgacgctgtgtttgatatcatcacagatgaggaattgtgccagatacaggagtccggctcctctttgcctgaaacacccactgaaactgattctcttgacccaaatgcggctgaacaggatactacatcaacctcgctaacgcctgaggacactgaagacatgcccgtggggcaggattcggaaatctgcctgctgaagtctggagaactgatgatcaaagtacccctcacagtggatgagatcgccagcttcggggagggtagcagggagctgtttgtgaggtccagcacctacagcctgatccccatcactgtggccgaggcaggcctcaccatcagctgggtcttctcctctgaccccaagagcatctccttcagtgtggtcttccaggaggccgaggacacaccgctggatcagtgtaaggtcctcattcccacgacccgatgcaactcccacaaggagaacatccagggccagctcaaggttcgcacacccggcatctacatgctcatcttcgacaataccttctcaaggtttgtctctaaaaaggtattttatcacttgacggttgatcggcctgtgatctacgatggaagtgatttcctgtagcttcagcacctcagtaacttcacttcatccacaggaaacactgctcttcctcacctgtcacataaagcatttttttaaaaagtcagctgctccaaaatcatcaactcagcccctgggctgcccctcagaggcggtgtctggggaggactttgtgctcagcactctgcaccggccactcttagcccccgaggcgttgaagggctcaggcaatgtttccattaagtagagactcagctgttgtcacacccaaagggatgctctgccaaaggtttaaacacccaggagaccatcagcctctcctgggagcacagttgactacaggcctcttgtggagagtttcacgggcaggggtgattccaacttctgcctgtggagagattttctgccctgccccaccagggccctgcatgttggagactgagctgggtgcactggccatnccctgtgaatcctcgggctgtgacgccctcaggtactcctgggaaaaggaggtacacagccatcatgcgagtcggtgccaggggaccccccggagatcctgaccagctcctccagtcatgctcttgtccctcactgccccagtaagctggaggctgctccagaactcagcagtgttggaggggcctctaagctgcactctctttctggcccttttgtctggctgattctgtcctcaaataaagcccttcactcagccagacctctccacagctcaaagcattgccctaagaatcagaagtaaagataatccaagagcaaaacccactgtacttggggcctgcaatggctgtgtgtacactacatctaatgcccaaatgccagccagtgtggatgttgtgaccacagagcaggattgtgcattggctttagagctactcctcagctgatggcccacttttgtttatataaataagagcttctgccccacctgcagacatgtttactaatgatcatagccaggattagaaccactttcaaacattggggccttcttaacaaaagtctttgataacttaagaaccaaagtaacagagtaaacagaggcatgatggatccctgggccccactcccctcctgacaggttccccaacagcccatttgcccacttcccactgctcagcccacaccagacctccaggagacatccccccttgaggcagagagatcctgttccctattcccagacaagaattatttaatcttccctgttctctgtggtccttttcttccccaacaacagatagctcaccttggacagctcttcgtcccttgttcatggaaccagctgcctgcagtcaggccccaggttcttccatgggtgaacagagcatctgacaaaaggtcccagtttggccaggggtgagggagagagcaccagacaggctatccgagaatctgagagctgggcccggcaattcctccagctacccttgtgacctaagtccagtcacacatttcccaaagtttctctttgtcataaccctggtctggctggttttgagggcttgagaatgggtcagggactccaggccaagtccaacagagaccccaaacccaccacacaccagcagccacaacctcaccaccaacaaagaggacttttgtggggccacaagtaagaggtcatttctggaatgaacatttggaattgcactttaattgattaatcctcaattcatgtggccttacgggatggtgggtctgggaccccaattcattcttatctgccaaagaattatctagaagcacatcaaataccagcaccccacctgcacaatgggggtggaaaacttttgtatccctaagcatattattttatagtgtctgccatgccatgtggaaatactttatttttaacctcaggatttaaataaagtaaacactatgacatttaaaaaaaaaac

SEQ ID NO: 307670 - DNA, 1679 bp, Homo sapiens
  misc_feature (1362)..(1362): n is a, c, g, or t
cgtcatggccgtcagcaccgcgttcccgtcctcttccgcttggccccagaaagtttcggttctgcccggcggtggacccacgagcgcgtgccaccatggagtctgaccactgctgagcagacagccaccgagggccgaaattctgagccttcctctggacccaggcaggagacatacagacaagaaaggcaaactcaccatggcctccaccaatgcagagagccagctccagagaatcatccgagacttgcaagatgctgtgacagaactaagcaaagaatttcaggaagcaggggaacccatcacggatgacagcaccagcttgcataaattttcttataaacttgagtatctcctgcaatttgatcagaaagagaaggccaccctcctgggcaacaagaaggactactgggattacttctgtgcctgcctggccaaggtgaaaggagccaatgatgggatccgatttgtcaagtctatctcagagctccgaacatccttggggaaaggaagagcatttattcgctactccttggtgcaccagaggttggcagacaccttacagcagtgcttcatgaacaccaaagtgaccagtgactggtactatgcaagaagcccctttctgcagccaaagctgagctcggacattgtgggccaactctatgagctgactgaggttcagtttgacctggcgtcgaggggctttgacttggatgctgcctggccaacatttgccaggaggacgctgaccactggctcttctgcttacctgtggaaaccccctagccgcagctccagcatgagcagcttggtgagcagctacctgcagactcaagagatggtgtccaactttgacctgaacagccccctaaacaacgaggcattggagggctttgatgagatgcgactagagctggaccagttggaggtgcgggagaagcagctacaggagcgcatgcagcagctggacagagagaaccaggagctgagggcagctgtcagccagcaaggggagcaactgcagacagagagggagagggggcgcactgcagcggaggacaacgttcgcctcacttgcttggtagctgagctccagaagcagtgggaggtcacccaggccacccagaacactgtgaaggagctgcagacatgcctgcaggccctggagctaggagcagcagagaaggaggaggactaccacacagccctgcggcggctggagtccatgctgcagcccttggcacaggagcttgaggccacacgggactcactggacaagaaaaaccagcatttagccagcttcccaggctggctagccatgggccctgcatgttggagactgagctgggtgcactggccatnccctgtgaatcctcgggctgtgacgccctcaggtactcctgggaaaaggaggtacacagccatcatgcgagtcggtgccaggggaccccccggagatcctgaccagctcctccagtcatgctcttgtccctcactgccccagtaagctggaggctgctccagaactcagcagtgttggaggggcctctaagctgcactctctttctggcccttttgtctggctgattctgtcctcaaataaagcccttcactcagccagacctctccacagctcaaagcattgccctaagaatcagaagtaaagataatccaagagc

SEQ ID NO: 307671 - DNA, 382 bp, Homo sapiens
ttcaaaaaagaagttttctttctcctacaattcccctttcttggcaaataattgatgtttaaggtttcccatatcctttttgagaagtagatatgatatatataataaatgaataagcatccagatcattgcagtaatttctttgaagaagagcaagcttatttgagagttatgttcttctaccatgaaaatgaaattggtttgtgtgcctgtgtcttttaatttagtaacctgagttggaattcgatgaggcagagccacagtgggaggactgagtaaattcatactttatctttattactcttataattgacatgtttttctgcagtgactggtactatgcaagaagcccctttctgcagccaaagctgagctcggacat

SEQ ID NO: 307672 - DNA, 4418 bp, Homo sapiens
agcaaactcgtcttgtctacccaccctccctcccccatcctccccaaaatagccttgtgatttcggaagtatggactaaaatcacactcctccttaccttaccgcttggactctggtggctcccaactcgccgtcagaccccacctgccccggtggtgggaagcgcctggacagaccatgaccacagccaaggagccaagcgcttcggggaaatccgtgcagcagcaggaacaggagctggtggggagtaaccctccgcagaggaattggaaaggaatagcaattgcactgcttgtcattctggtcatctgctccttgatcgtcacctcggtcatacttctgacaccagcggaagataatagtctgtctcaaaagaagaaggtcactgtagaagatctcttcagtgaagacttcaaaattcatgaccccgaggctaagtggataagtgatacagaattcatctacagagaacagaaaggaacagtgagactgtggaatgttgaaacaaatacttctactgtcttaatagaaggcaaaaaaattgaatcattaagagccatcagatatgaaatatctccagatagagagtatgcacttttttcatacaatgtggaacccatatatcaacactcgtatactggatattatgtcctgagcaaaattcctcatggggatcctcaaagtctggacccaccagaagtcagcaatgcaaagcttcagtatgcaggatggggccctaaaggccaacagctgatatttatttttgaaaacaatatctactactgtgcacatgtcgggaaacaggccatccgtgtggtctccactggcaaggaaggtgtgatttacaatggcctcagtgactggctgtatgaagaggagattttgaagacacacatcgcacactggtggtctccggatggcacgagactcgcctacgccgccatcaatgattcccgtgtccccatcatggagctcccaacttacaccggctccatctaccccaccgtgaagccctaccactatcccaaggctggaagtgagaaccccagcatttccctacacgttattggcttaaatggacccacccatgatctggagatgatgccgcctgatgatccacggatgagggagtactacatcaccatggtgaagtgggccaccagcaccaaggtcgccgtgacctggctgaaccgggcgcagaacgtgtccatcctcaccctctgcgacgccaccacgggggtctgcacgaagaaacacgaggatgaaagtgaggcctggctccacagacagaatgaagaacctgtgttctccaaggatggccgaaagtttttcttcatcagagccatcccccagggaggacgagggaaattctatcacatcacggtgtcctcgtcccagcccaacagcagcaacgacaacatccagtccatcacctccggggactgggacgtgaccaagatcctagcctacgatgagaaggggaataagatctacttcctgagcacggaggacctgcctcggagacgacaactctacagtgccaacacggtgggcaacttcaacaggcagtgcctctcctgtgacctggttgagaactgcacctacttcagcgcttccttcagccatagcatggacttcttcctgctcaagtgcgaaggtcctggtgttcctatggtgacggtgcacaacacaacagataagaaaaaaatgtttgacctagaaacaaatgaacatgtcaagaaggccataaatgaccgacagatgcctaaagtggaatacagggacattgagattgatgattacaacctgcccatgcagatactgaagccagcaaccttcaccgacaccacccactaccctctgctcctggtggtggatggcaccccgggcagccagagtgtagctgagaagttcgaggtgagctgggagacggtgatggtgagcagccacggcgcggtggtggtaaagtgtgacggccgtggcagcggcttccaagggaccaagctcctgcacgaagtgaggcggcggctgggcttgctggaggagaaggaccagatggaggccgtgcggacgatgctgaaggagcagtacattgacaggacgcgcgtggccgtgttcgggaaggattacggtggctacctgagcacctacatcctcccagcaaagggagaaaatcaaggccagacattcacctgcggctctgctctctctccaataacagacttcaaactctatgcctctgcgttttccgagaggtacttgggcctccatggacttgacaacagagcatacgagatgaccaaggtagcccatcgagtctccgcgctggaagaacagcagttcctgatcattcatcccactgccgatgaaaaaattcatttccagcacacagcagaactcattacacaactaattaggggaaaggctaattacagcttacagatttacccggacgaaagccattactttaccagctccagcctcaaacagcatctgtaccggtccatcatcaacttcttcgtggaatgcttcaggatccaggacaaactgccgacagtcacagcgaaagaggacgaggaggaggactaagctcaggtcgctctaagcacaaacgtggctctttctacaaccagatgcaaccgagggatttccctgccctccctcttccctcggaggggcggggcggggcggggccgggtgtaccatagcatgtgtgtctcggatgcggaaggcagttttgcttgggaaacaagctccttccccggggtcatcactcacggcctccatggcaccagggacaacgctgtccccgcagcagcgcctcctcccggcgcccgagagaccggcacgccacggcccctcccccaaggaacagagcaaaggatggtggccgcaggccccacgcgagcccacaggacaccggcccctagattccagccaccaagcggaagcatgagacccgcccacactagcctctgtgttcccgttagggacatcacaccctgtctcacgtcgcagtgccatggacgcagcagttacagcaccattgttttagcagtgcgtgttcatatatgggcttgctacttcctgtaatgaggacgttcaacatggtgaggggctacaagaaaacgcttttctgtacagagtcttactgtagctacgctaatggttaacctgatagaattaactcgtatttttctatggttttaacctgatgctccactgtctccgtcatggggttgttttgctgtttggggttgggccttgtttccctttcctttctccagtccacgtgtagactttgcgcttgtttggatgaagaagcagatcggaagtaactgctccctcctcaaggttgtcttcagacgtcttggagacgttcctaaacactgagggggaagacagccaatagcacccattaaaagaaatacctaaataaaacctctctcccactcagctatgctagggcttggctgtaggtgtgcactgtctatttacatccgtccttacaaccatccttgtcctccttggtaccgtatcaagctctttcccatgacatttggttaaaaaaaaaaaaaaaaaaaaaaaaaaaaacagaaaaaagacaaagcgtcaactccacccacaggcccgctgtgtgtgctcgggccacgggagtcctgagggttctgtgggcctgcgcgcatccctctcccatcgtgggggtggctccgtgaccttcctgccacgagcaggaggttgatgatgtgctacgttagccttgtaagatacacccccaccaaatgtgcagccggtgttcccagtgtatatttcattctcttgtatataaaggaagcaatgtgtgtcaggcctctgtgcagtcaacccagcctcctcccgccagtgctaaccccgtgttgagcctgcatgctgacactgtggccgatctggactctagaagtgctagtttgaaatatatccattactgtcatttccttttgagcttgtggacaagctgaatgtcaggactgacttctccagctcccagccctgcgggggtgtccttggcatcccatcagcagaggagatgcgtccctgttgcattttggcgtttggggctttgggtttatccacatgagctctgaacgtccgttatagttagggtgattggaaggtctccatcactgggtgttttaaaggtgattcaccaccatttgtgaaaggaccaacgtgctgataaacaggaccgatccgagtgctacatgactgtgcgtttgctatttcaatgggcctgaacgactacaaagccagctaggtctggaaggggaagccagctctggccacgacatctggtcggagggaagtggggatgtggcatggtagcgtctgttcatccatggaataaaacattattttaccaaaaacggattgttcctttc

SEQ ID NO: 307673 - DNA, 4432 bp, Homo sapiens
agcaaactcgtcttgtctacccaccctccctcccccatcctccccaaaatagccttgtgatttcggaagtatggactaaaatcacactcctccttaccttaccgcttggactctggtggctcccaactcgccgtcagaccccacctgccccggtggtgggaagcgcctggacagaccatgaccacagccaaggagccaagcgcttcggggaaatccgtgcagcagcaggaacaggagctggtggggagtaaccctccgcagaggaattggaaaggaatagcaattgcactgcttgtcattctggtcatctgctccttgatcgtcacctcggtcatacttctgacaccagcggaagataatagtctgtctcaaaagaagaaggtcactgtagaagatctcttcagtgaagacttcaaaattcatgaccccgaggctaagtggataagtgatacagaattcatctacagagaacagaaaggaacagtgagactgtggaatgttgaaacaaatacttctactgtcttaatagaaggcaaaaaaattgaatcattaagagccatcagatatgaaatatctccagatagagagtatgcacttttttcatacaatgtggaacccatatatcaacactcgtatactggatattatgtcctgagcaaaattcctcatggggatcctcaaagtctggacccaccagaagtcagcaatgcaaagcttcagtatgcaggatggggccctaaaggccaacagctgatatttatttttgaaaacaatatctactactgtgcacatgtcgggaaacaggccatccgtgtggtctccactggcaaggaaggtgtgatttacaatggcctcagtgactggctgtatgaagaggagattttgaagacacacatcgcacactggtggtctccggatggcacgagactcgcctacgccgccatcaatgattcccgtgtccccatcatggagctcccaacttacaccggctccatctaccccaccgtgaagccctaccactatcccaaggctggaagtgagaaccccagcatttccctacacgttattggcttaaatggacccacccatgatctggagatgatgccgcctgatgatccacggatgagggagtactacatcaccatggtgaagtgggccaccagcaccaaggtcgccgtgacctggctgaaccgggcgcagaacgtgtccatcctcaccctctgcgacgccaccacgggggtctgcacgaagaaacacgaggatgaaagtgaggcctggctccacagacagaatgaagaacctgtgttctccaaggatggccgaaagtttttcttcatcagagccatcccccagggaggacgagggaaattctatcacatcacggtgtcctcgtcccagcccaacagcagcaacgacaacatccagtccatcacctccggggactgggacgtgaccaagatcctagcctacgatgagaaggggaataagatctacttcctgagcacggaggacctgcctcggagacgacaactctacagtgccaacacggtgggcaacttcaacaggcagtgcctctcctgtgacctggttgagaactgcacctacttcagcgcttccttcagccatagcatggacttcttcctgctcaagtgcgaaggtcctggtgttcctatggtgacggtgcacaacacaacagataagaaaaaaatgtttgacctagaaacaaatgaacatgtcaagaaggccataaatgaccgacagatgcctaaagtggaatacagggacattgagattgatgattacaacctgcccatgcagatactgaagccagcaaccttcaccgacaccacccactaccctctgctcctggtggtggatggcaccccgggcagccagagtgtagctgagaagttcgaggtgagctgggagacggtgatggtgagcagccacggcgcggtggtggtaaagtgtgacggccgtggcagcggcttccaagggaccaagctcctgcacgaagtgaggcggcggctgggcttgctggaggagaaggaccagatggaggccgtgcggacgatgctgaaggagcagtacattgacaggacgcgcgtggccgtgttcgggaaggattacggtggctacctgagcacctacatcctcccagcaaagggagaaaatcaaggccagacattcacctgcggctctgctctctctccaataacagacttcaaactctatgcctctgcgttttccgagaggtacttgggcctccatggacttgacaacagagcatacgagatgaccaaggtagcccatcgagtctccgcgctggaagaacagcagttcctgatcattcatcccactgccgatgaaaaaattcatttccagcacacagcagaactcattacacaactaattaggggaaaggctaattacagcttacagatttacccggacgaaagccattactttaccagctccagcctcaaacagcatctgtaccggtccatcatcaacttcttcgtggaatgcttcaggatccaggacaaactgccgacagtcacagcgaaagaggacgaggaggaggactaagctcaggtcgctctaagcacaaacgtggctctttctacaaccagatgcaaccgagggatttccctgccctccctcttccctcggaggggcggggcggggcggggccgggtgtaccatagcatgtgtgtctcggatgcggaaggcagttttgcttgggaaacaagctccttccccggggtcatcactcacggcctccatggcaccagggacaacgctgtccccgcagcagcgcctcctcccggcgcccgagagaccggcacgccacggcccctcccccaaggaacagagcaaaggatggtggccgcaggccccacgcgagcccacaggacaccggcccctagattccagccaccaagcggaagcatgagacccgcccacactagcctctgtgttcccgttagggacatcacaccctgtctcacgtcgcagtgccatggacgcagcagttacagcaccattgttttagcagtgcgtgttcatatatgggcttgctacttcctgtaatgaggacgttcaacatggtgaggggctacaagaaaacgcttttctgtacagagtcttactgtagctacgctaatggttaacctgatagaattaactcgtatttttctatggttttaacctgatgctccactgtctccgtcatggggttgttttgctgtttggggttgggccttgtttccctttcctttctccagtccacgtgtagactttgcgcttgtttggatgaagaagcagatcggaagtaactgctccctcctcaaggttgtcttcagacgtcttggagacgttcctaaacactgagggggaagacagccaatagcacccattaaaagaaatacctaaataaaacctctctcccactcagctatgctagggcttggctgtaggtgtgcactgtctatttacatccgtccttacaaccatccttgtcctccttggtaccgtatcaagctctttcccatgacatttggttaaaaaaaaaaaaaaaaaaaaaaaaaaaaacagaaaaaagacaaagcgtcaactccacccacaggcccgctgtgtgtgctcgggccacgggagtcctgagggttctgtgggcctgcgcgcatccctctcccatcgtgggggtggctccgtgaccttcctgccacgagcaggaggttgatgatgtgctacgttagccttgtaagatacacccccaccaaatgtgcagccggtgttcccagtgtatatttcattctcttgtatataaaggaagcaatgtgtgtcaggcctctgtgcagtcaacccagcctcctcccgccagtgctaaccccgtgttgagcctgcatgctgacactgtggccgatctggactctagaagtgctagtttgaaatatatccattactgtcatttccttttgagcttgtggacaagctgaatgtcaggactgacttctccagctcccagccctgcgggggtgtccttggcatcccatcagcagaggagatgcgtccctgttgcattttggcgtttggggctttgggtttatccacatgagctctgaacgtccgttatagttagggtgattggaaggtctccatcactgggtgttttaaaggtgattcaccaccatttgtgaaaggaccaacgtgctgataaacaggaccgatccgagtgctacatgactgtgcgtttgctatttcaatgggcctgaacgactacaaagccagctaggtctgatgggagcaagatgcgccatcttctcccatcagtctgcctgctctgcaagcctcattatccccattttgttaagtagctgggcctggagtccccacacaggttaagaaccacccaggggggaatgttatgttg

SEQ ID NO: 307674 - DNA, 4570 bp, Homo sapiens
gacgctgggcttgcttgctgctgctgctgctgcctccccaccgcctttttttttttaatctggagcggggtggggagtgggaaccggagagaaagcaaaatattaaaaagccccaaagacagccagcaggagcgcggtgcccgatggcttcgctgtaccagaggttcactggcaagatcaacacctcgaggtccttccccgcgcccccggaggcgagtcacctcctgggcggccaggggcccgaggaggacggcggcgcaggagccaagcccctcggcccgcgggcgcaggcggcggcgccccgggagcgcggcggcggcggcggcggcgcgggtggccggccccggttccagtaccaggcgcggagcgatggtgacgaggaggacgagctggtggggagtaaccctccgcagaggaattggaaaggaatagcaattgcactgcttgtcattctggtcatctgctccttgatcgtcacctcggtcatacttctgacaccagcggaagataatagtctgtctcaaaagaagaaggtcactgtagaagatctcttcagtgaagacttcaaaattcatgaccccgaggctaagtggataagtgatacagaattcatctacagagaacagaaaggaacagtgagactgtggaatgttgaaacaaatacttctactgtcttaatagaaggcaaaaaaattgaatcattaagagccatcagatatgaaatatctccagatagagagtatgcacttttttcatacaatgtggaacccatatatcaacactcgtatactggatattatgtcctgagcaaaattcctcatggggatcctcaaagtctggacccaccagaagtcagcaatgcaaagcttcagtatgcaggatggggccctaaaggccaacagctgatatttatttttgaaaacaatatctactactgtgcacatgtcgggaaacaggccatccgtgtggtctccactggcaaggaaggtgtgatttacaatggcctcagtgactggctgtatgaagaggagattttgaagacacacatcgcacactggtggtctccggatggcacgagactcgcctacgccgccatcaatgattcccgtgtccccatcatggagctcccaacttacaccggctccatctaccccaccgtgaagccctaccactatcccaaggctggaagtgagaaccccagcatttccctacacgttattggcttaaatggacccacccatgatctggagatgatgccgcctgatgatccacggatgagggagtactacatcaccatggtgaagtgggccaccagcaccaaggtcgccgtgacctggctgaaccgggcgcagaacgtgtccatcctcaccctctgcgacgccaccacgggggtctgcacgaagaaacacgaggatgaaagtgaggcctggctccacagacagaatgaagaacctgtgttctccaaggatggccgaaagtttttcttcatcagagccatcccccagggaggacgagggaaattctatcacatcacggtgtcctcgtcccagcccaacagcagcaacgacaacatccagtccatcacctccggggactgggacgtgaccaagatcctagcctacgatgagaaggggaataagatctacttcctgagcacggaggacctgcctcggagacgacaactctacagtgccaacacggtgggcaacttcaacaggcagtgcctctcctgtgacctggttgagaactgcacctacttcagcgcttccttcagccatagcatggacttcttcctgctcaagtgcgaaggtcctggtgttcctatggtgacggtgcacaacacaacagataagaaaaaaatgtttgacctagaaacaaatgaacatgtcaagaaggccataaatgaccgacagatgcctaaagtggaatacagggacattgagattgatgattacaacctgcccatgcagatactgaagccagcaaccttcaccgacaccacccactaccctctgctcctggtggtggatggcaccccgggcagccagagtgtagctgagaagttcgaggtgagctgggagacggtgatggtgagcagccacggcgcggtggtggtaaagtgtgacggccgtggcagcggcttccaagggaccaagctcctgcacgaagtgaggcggcggctgggcttgctggaggagaaggaccagatggaggccgtgcggacgatgctgaaggagcagtacattgacaggacgcgcgtggccgtgttcgggaaggattacggtggctacctgagcacctacatcctcccagcaaagggagaaaatcaaggccagacattcacctgcggctctgctctctctccaataacagacttcaaactctatgcctctgcgttttccgagaggtacttgggcctccatggacttgacaacagagcatacgagatgaccaaggtagcccatcgagtctccgcgctggaagaacagcagttcctgatcattcatcccactgccgatgaaaaaattcatttccagcacacagcagaactcattacacaactaattaggggaaaggctaattacagcttacagatttacccggacgaaagccattactttaccagctccagcctcaaacagcatctgtaccggtccatcatcaacttcttcgtggaatgcttcaggatccaggacaaactgccgacagtcacagcgaaagaggacgaggaggaggactaagctcaggtcgctctaagcacaaacgtggctctttctacaaccagatgcaaccgagggatttccctgccctccctcttccctcggaggggcggggcggggcggggccgggtgtaccatagcatgtgtgtctcggatgcggaaggcagttttgcttgggaaacaagctccttccccggggtcatcactcacggcctccatggcaccagggacaacgctgtccccgcagcagcgcctcctcccggcgcccgagagaccggcacgccacggcccctcccccaaggaacagagcaaaggatggtggccgcaggccccacgcgagcccacaggacaccggcccctagattccagccaccaagcggaagcatgagacccgcccacactagcctctgtgttcccgttagggacatcacaccctgtctcacgtcgcagtgccatggacgcagcagttacagcaccattgttttagcagtgcgtgttcatatatgggcttgctacttcctgtaatgaggacgttcaacatggtgaggggctacaagaaaacgcttttctgtacagagtcttactgtagctacgctaatggttaacctgatagaattaactcgtatttttctatggttttaacctgatgctccactgtctccgtcatggggttgttttgctgtttggggttgggccttgtttccctttcctttctccagtccacgtgtagactttgcgcttgtttggatgaagaagcagatcggaagtaactgctccctcctcaaggttgtcttcagacgtcttggagacgttcctaaacactgagggggaagacagccaatagcacccattaaaagaaatacctaaataaaacctctctcccactcagctatgctagggcttggctgtaggtgtgcactgtctatttacatccgtccttacaaccatccttgtcctccttggtaccgtatcaagctctttcccatgacatttggttaaaaaaaaaaaaaaaaaaaaaaaaaaaaacagaaaaaagacaaagcgtcaactccacccacaggcccgctgtgtgtgctcgggccacgggagtcctgagggttctgtgggcctgcgcgcatccctctcccatcgtgggggtggctccgtgaccttcctgccacgagcaggaggttgatgatgtgctacgttagccttgtaagatacacccccaccaaatgtgcagccggtgttcccagtgtatatttcattctcttgtatataaaggaagcaatgtgtgtcaggcctctgtgcagtcaacccagcctcctcccgccagtgctaaccccgtgttgagcctgcatgctgacactgtggccgatctggactctagaagtgctagtttgaaatatatccattactgtcatttccttttgagcttgtggacaagctgaatgtcaggactgacttctccagctcccagccctgcgggggtgtccttggcatcccatcagcagaggagatgcgtccctgttgcattttggcgtttggggctttgggtttatccacatgagctctgaacgtccgttatagttagggtgattggaaggtctccatcactgggtgttttaaaggtgattcaccaccatttgtgaaaggaccaacgtgctgataaacaggaccgatccgagtgctacatgactgtgcgtttgctatttcaatgggcctgaacgactacaaagccagctaggtctggaaggggaagccagctctggccacgacatctggtcggagggaagtggggatgtggcatggtagcgtctgttcatccatggaataaaacattattttaccaaaaacggattgttcctttc

SEQ ID NO: 307675 - DNA, 4625 bp, Homo sapiens
agcgggcagtgtgctggcgccgagctcggtggacacgcgcgcagtcagagctgcctctcgccctcgctagctgggctcgcagcctcttcctccctccctggctcctggctttttgtttaaagcaacacccaccctccatccaggctttttttctttctttctttattggtagcggccaaaaagagttgattgctattgggatccgctgagtaaagacacgggcaggggtgcgcggaggtgagaaaactgaagacctggaagatttttttttccttcaaaaacccgtttccatccagtcttcagccagtccagtctactttaatcctcaccaggacaatggattaagtttctcttccctggaccagaagtcgggttcggacttggggcaaaatgaaggaaaaggccatgatcaagaccgctaagatgcaggggaacgtgatggagctggtggggagtaaccctccgcagaggaattggaaaggaatagcaattgcactgcttgtcattctggtcatctgctccttgatcgtcacctcggtcatacttctgacaccagcggaagataatagtctgtctcaaaagaagaaggtcactgtagaagatctcttcagtgaagacttcaaaattcatgaccccgaggctaagtggataagtgatacagaattcatctacagagaacagaaaggaacagtgagactgtggaatgttgaaacaaatacttctactgtcttaatagaaggcaaaaaaattgaatcattaagagccatcagatatgaaatatctccagatagagagtatgcacttttttcatacaatgtggaacccatatatcaacactcgtatactggatattatgtcctgagcaaaattcctcatggggatcctcaaagtctggacccaccagaagtcagcaatgcaaagcttcagtatgcaggatggggccctaaaggccaacagctgatatttatttttgaaaacaatatctactactgtgcacatgtcgggaaacaggccatccgtgtggtctccactggcaaggaaggtgtgatttacaatggcctcagtgactggctgtatgaagaggagattttgaagacacacatcgcacactggtggtctccggatggcacgagactcgcctacgccgccatcaatgattcccgtgtccccatcatggagctcccaacttacaccggctccatctaccccaccgtgaagccctaccactatcccaaggctggaagtgagaaccccagcatttccctacacgttattggcttaaatggacccacccatgatctggagatgatgccgcctgatgatccacggatgagggagtactacatcaccatggtgaagtgggccaccagcaccaaggtcgccgtgacctggctgaaccgggcgcagaacgtgtccatcctcaccctctgcgacgccaccacgggggtctgcacgaagaaacacgaggatgaaagtgaggcctggctccacagacagaatgaagaacctgtgttctccaaggatggccgaaagtttttcttcatcagagccatcccccagggaggacgagggaaattctatcacatcacggtgtcctcgtcccagcccaacagcagcaacgacaacatccagtccatcacctccggggactgggacgtgaccaagatcctagcctacgatgagaaggggaataagatctacttcctgagcacggaggacctgcctcggagacgacaactctacagtgccaacacggtgggcaacttcaacaggcagtgcctctcctgtgacctggttgagaactgcacctacttcagcgcttccttcagccatagcatggacttcttcctgctcaagtgcgaaggtcctggtgttcctatggtgacggtgcacaacacaacagataagaaaaaaatgtttgacctagaaacaaatgaacatgtcaagaaggccataaatgaccgacagatgcctaaagtggaatacagggacattgagattgatgattacaacctgcccatgcagatactgaagccagcaaccttcaccgacaccacccactaccctctgctcctggtggtggatggcaccccgggcagccagagtgtagctgagaagttcgaggtgagctgggagacggtgatggtgagcagccacggcgcggtggtggtaaagtgtgacggccgtggcagcggcttccaagggaccaagctcctgcacgaagtgaggcggcggctgggcttgctggaggagaaggaccagatggaggccgtgcggacgatgctgaaggagcagtacattgacaggacgcgcgtggccgtgttcgggaaggattacggtggctacctgagcacctacatcctcccagcaaagggagaaaatcaaggccagacattcacctgcggctctgctctctctccaataacagacttcaaactctatgcctctgcgttttccgagaggtacttgggcctccatggacttgacaacagagcatacgagatgaccaaggtagcccatcgagtctccgcgctggaagaacagcagttcctgatcattcatcccactgccgatgaaaaaattcatttccagcacacagcagaactcattacacaactaattaggggaaaggctaattacagcttacagatttacccggacgaaagccattactttaccagctccagcctcaaacagcatctgtaccggtccatcatcaacttcttcgtggaatgcttcaggatccaggacaaactgccgacagtcacagcgaaagaggacgaggaggaggactaagctcaggtcgctctaagcacaaacgtggctctttctacaaccagatgcaaccgagggatttccctgccctccctcttccctcggaggggcggggcggggcggggccgggtgtaccatagcatgtgtgtctcggatgcggaaggcagttttgcttgggaaacaagctccttccccggggtcatcactcacggcctccatggcaccagggacaacgctgtccccgcagcagcgcctcctcccggcgcccgagagaccggcacgccacggcccctcccccaaggaacagagcaaaggatggtggccgcaggccccacgcgagcccacaggacaccggcccctagattccagccaccaagcggaagcatgagacccgcccacactagcctctgtgttcccgttagggacatcacaccctgtctcacgtcgcagtgccatggacgcagcagttacagcaccattgttttagcagtgcgtgttcatatatgggcttgctacttcctgtaatgaggacgttcaacatggtgaggggctacaagaaaacgcttttctgtacagagtcttactgtagctacgctaatggttaacctgatagaattaactcgtatttttctatggttttaacctgatgctccactgtctccgtcatggggttgttttgctgtttggggttgggccttgtttccctttcctttctccagtccacgtgtagactttgcgcttgtttggatgaagaagcagatcggaagtaactgctccctcctcaaggttgtcttcagacgtcttggagacgttcctaaacactgagggggaagacagccaatagcacccattaaaagaaatacctaaataaaacctctctcccactcagctatgctagggcttggctgtaggtgtgcactgtctatttacatccgtccttacaaccatccttgtcctccttggtaccgtatcaagctctttcccatgacatttggttaaaaaaaaaaaaaaaaaaaaaaaaaaaaacagaaaaaagacaaagcgtcaactccacccacaggcccgctgtgtgtgctcgggccacgggagtcctgagggttctgtgggcctgcgcgcatccctctcccatcgtgggggtggctccgtgaccttcctgccacgagcaggaggttgatgatgtgctacgttagccttgtaagatacacccccaccaaatgtgcagccggtgttcccagtgtatatttcattctcttgtatataaaggaagcaatgtgtgtcaggcctctgtgcagtcaacccagcctcctcccgccagtgctaaccccgtgttgagcctgcatgctgacactgtggccgatctggactctagaagtgctagtttgaaatatatccattactgtcatttccttttgagcttgtggacaagctgaatgtcaggactgacttctccagctcccagccctgcgggggtgtccttggcatcccatcagcagaggagatgcgtccctgttgcattttggcgtttggggctttgggtttatccacatgagctctgaacgtccgttatagttagggtgattggaaggtctccatcactgggtgttttaaaggtgattcaccaccatttgtgaaaggaccaacgtgctgataaacaggaccgatccgagtgctacatgactgtgcgtttgctatttcaatgggcctgaacgactacaaagccagctaggtctggaaggggaagccagctctggccacgacatctggtcggagggaagtggggatgtggcatggtagcgtctgttcatccatggaataaaacattattttaccaaaaacggattgttcctttc

SEQ ID NO: 307676 - DNA, 1429 bp, Homo sapiens
cgcactgctaaaacaatggtgcgtgttcatatatgggcttgctacttcttgtagcccctcaccatgttgaacgtcctcattacaggaagtagcaagcccatatatgaagacgttcaacatggtgaggggctacaagaaaacgcttttctgtacagagtcttactgtagctacgctaatggttaacctgatagaattaactcgtatttttctatggttttaacctgatgctccactgtctccgtcatggggttgttttgctgtttggggttgggccttgtttccctttcctttctccagtccacgtgtagactttgcgcttgtttggatgaagaagcagatcggaagtaactgctccctcctcaaggttgtcttcagacgtcttggagacgttcctaaacactgagggggaagacagccaatagcacccattaaaagaaatacctaaataaaacctctctcccactcagctatgctagggcttggctgtaggtgtgcactgtctatttacatccgtccttacaaccatccttgtcctccttggtaccgtatcaagctctttcccatgacatttggttaaaaaaaaaaaaaaaaaaaaaaaaaaaaacagaaaaaagacaaagcgtcaactccacccacaggcccgctgtgtgtgctcgggccacgggagtcctgagggttctgtgggcctgcgcgcatccctctcccatcgtgggggtggctccgtgaccttcctgccacgagcaggaggttgatgatgtgctacgttagccttgtaagatacacccccaccaaatgtgcagccggtgttcccagtgtatatttcattctcttgtatataaaggaagcaatgtgtgtcaggcctctgtgcagtcaacccagcctcctcccgccagtgctaaccccgtgttgagcctgcatgctgacactgtggccgatctggactctagaagtgctagtttgaaatatatccattactgtcatttccttttgagcttgtggacaagctgaatgtcaggactgacttctccagctcccagccctgcgggggtgtccttggcatcccatcagcagaggagatgcgtccctgttgcattttggcgtttggggctttgggtttatccacatgagctctgaacgtccgttatagttagggtgattggaaggtctccatcactgggtgttttaaaggtgattcaccaccatttgtgaaaggaccaacgtgctgataaacaggaccgatccgagtgctacatgactgtgcgtttgctatttcaatgggcctgaacgactacaaagccagctaggtctggaaggggaagccagctctggccacgacatctggtcggagggaagtggggatgtggcatggtagcgtctgttcatccatggaataaaacattattttaccaaaaacggattgttcctttc

SEQ ID NO: 307677 - DNA, 324 bp, Homo sapiens
tcccaccactgacattcgggggtcggggaggctgcgggcctggggttggttgggaagcctcaaggaggatgttgcctcccaggagaggagcaggcagaaggggcagagagcccttcccacagagagaatggcagcccctgtcacctggtgtccaaaacagttggaggatgaagagccatgctggggccgggacaccggtgtctgctcctgatgccatgtctgtgtgtttcagcccaacagcagcaacgacaacatccagtccatcacctccggggactgggacgtgaccaagatcctagcctacgatgagaaggggaataagat

SEQ ID NO: 307678 - DNA, 402 bp, Homo sapiens
atgaaagcagcagttacgcacatgaaaagccatggcccgcagaggtcctccatgagtgaccactgcatctcagtgtgtccctgtttcctctctttcagaaatgtttgacctagaaacaaatgaacatgtcaagaaggccataaatgaccgacagatgcctaaagtggaatacagggacattgagattgatgattacagtaagtactacgtttttcccctctaaaagaaaaagaaaaagaaaacgtgggctgtgacacagtgcagtcatcagcagcaggtgccctgcaaggaagactccccaagcacgggggtgtatctttgcccctcagctcctctggcatggagtgtcttgtgttcagaaccaagatgctcactctggtgacaaaaccaaaaaaagcaggg

SEQ ID NO: 307679 - DNA, 306 bp, Homo sapiens
ctcccagtgtctttgggtttatttagcaagaggtaatgactgggcggcccctcagagtcccgcgccagtgcagattctttataagccagatttcagaagctcgcaggctggctgtgtcaccactggctccggcccccggctcccgtgtcgtgtccagggctggggtcggcggtcccctggcttctgtcgtgcgggggtcctgccaagctgctcatgctgtgtttggcgtttccagggagtactacatcaccatggtgaagtgggccaccagcaccaaggtcgccgtgacctggctgaaccgggcgc

SEQ ID NO: 307680 - DNA, 477 bp, Homo sapiens
cccactgagcatttgctgtgcctggagagggccaggcaccgggggcgtggtggtgtttgaaggctggttggcttcacgaatgggtggtgcatgtccacgctaggggaggcgcccctctgactgggacagccaggcagatctcccaggaggaagaggcacttccatcaggagtggcatggttagcaaacccacttcatcaactacaatccagccccggacggggcccaggtttcactaaactccacaccttctgtgcgttcccgtcccctggggagcgtatacctgggagagtaatttctccgtgccttccttgcagatttacccggacgaaagccattactttaccagctccagcctcaaacagcatctgtaccggtccatcatcaacttcttcgtggaatgcttcaggatccaggacaaactgccgacagtcacagcgaaagaggacgaggaggaggactaagctcaggtcgctct

SEQ ID NO: 307681 - DNA, 284 bp, Homo sapiens
cagaactagtgattttactttacataagcattcgtcaaaagttgaggagagttccttgatgtttcatgtggtttttttctacttcctctcttacagatacagaattcatctacagagaacagaaaggaacagtgagactgtggaatgttgaaacaaatacttctactgtcttaatagaaggcaaaaaaattgtaagtactctctttaatgaccgggataatttcagtttttcttcctgcaagtcaataaaacagaaaatgacttttggtttcaacttttagcat

SEQ ID NO: 307682 - DNA, 1052 bp, Homo sapiens
gtgggcggtcccaggcaggcccagaagctgggcagcctctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaaggaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagcctttgggctgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaa

SEQ ID NO: 307683 - DNA, 790 bp, Homo sapiens
gtgggcggtcccaggcaggcccagaagctgggcagcctctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaagggtgagtgtggggctctgggaatcctctgggaggaccttggatgactttctgaccttccccaggcacgttttcagggtcatgatcctgcccccgcccgggggatctactgtcctcccagtcacacccctctccccgcaccgccttcctgctgtcttctcttcttcccagaatgaagacatcaccgagccgcagagcatcctggcgtgagagaaaggtggttttctgcaaacaagcccagggcttttgaacgagcctttgggtgccctaacccggccacgggttggcaaccccaaatatttgttctgccggta

SEQ ID NO: 307684 - DNA, 501 bp, Homo sapiens
gttcaaggttgagtgggcaggggctgtcttcaaccccataaaagaaaaggaagccttctataccttgaagccaagcaaaagtctttctagaaaacccctgggaccttgtgggaccaactcctgctgccagaacacctgagaacagtgtgcagagtctgttgttttcttcatccaggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaa

SEQ ID NO: 307685 - DNA, 153 bp, Homo sapiens
gcggccgcctactactactactactgctcgaattcaagcttctaacgatgtacggggccatgtggcaacctttacttctatgcctcacaagtgcctttcagagagccccaattctgctttcccacaaaataaacctaatgccatcaggcaaaa

SEQ ID NO: 307686 - DNA, 1069 bp, Homo sapiens
tgagtaggacacggcgaccgtgtattatacaggcaggttactgaactagtgggcgtggcgacaatctgagaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaaggaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagcctttgggctgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaa

SEQ ID NO: 307687 - DNA, 1456 bp, Homo sapiens
tgagtaggacacggcgaccgtgtattatacaggcaggttactgaactagtgggcgtggcgacaatctgagaaaaggagctcctgctgccactgctcttccggagcctgcagcatggggcccctgccgcgcaccgtggagctcttctatgacgtgctgtccccctactcctggctgggcttcgaggtgacgctgggaggggtcgcctcggcagtgtctggggagtgagggcggagggaagagtgagcgcagggctccgggacagaggtctcgtgtaactcctggcgccgcccaaggggttaaggcaagcagggagagctccggggctgaaggtcactttgtgcttttaaacggaatagagtcgctggctccaacccgagcctttatatcccgactgcagtttcccacggtggtggaaagaggggcggctccaaacattcagggagaaatgcagaacacggccacctcttagcccaacgatggcagttttggggaaaactggccacaggagcgaagatcctggaatagatttctagtagtgaggagagttttgccaatttcaaaccaaacaatatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaaggaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagcctttgggctgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaa

SEQ ID NO: 307688 - DNA, 1020 bp, Homo sapiens
tgagtaggacacggcgaccgtgtattatacaggcaggttactgaactagtgggcgtggcgacaatctgagaaaaggagctcctgctgccactgctcttccggagcctgcagcatggggcccctgccgcgcaccgtatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaaggaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagcctttgggctgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaa

SEQ ID NO: 307689 - DNA, 1187 bp, Homo sapiens
tgagtaggacacggcgaccgtgtattatacaggcaggttactgaactagtgggcgtggcgacaatctgagaaaaggagctcctgctgccactgctcttccggagcctgcagcatggggcccctgccgcgcaccgtggagctcttctatgacgtgctgtccccctactcctggctgggcttcgaggtgacgctgggaggggtcgcctcggcagtgtctggggagtgagggcggagggaagagtgagcgcagggctccgggacagaggtctcgtgtaactcctggcgccgcccaaggggttaagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaaggaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagcctttgggctgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaa

SEQ ID NO: 307690 - DNA, 953 bp, Homo sapiens
cgcaccattgcactccagcctgggcaacaagagcgaaacaacaagagaaaaaaaaggaagctgccctctgcccaaaacccacgtcgaggtccccaaacctgggacccttaggtcttttctcacttagcgtgcccaaccttctcctggcaggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaaggaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagcctttgggctgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaa

SEQ ID NO: 307691 - DNA, 825 bp, Homo sapiens
agggcgatgaggactaggatgatggcgggcaggatagtccaaaggcaggacaagggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaaggaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagcctttgggctgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaa

SEQ ID NO: 307692 - DNA, 1220 bp, Homo sapiens
gtgggcggtcccaggcaggcccagaagctgggcagcctctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaagggtgagtgtggggctctgggaatcctctgggaggaccttggatgactttctgaccttccccaggcacgttttcagggtcatgatcctgcccccgcccgggggatctactgtcctcccagtcacacccctctccccgcaccgccttcctgctgtcttctcttcttcccagaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagcctttgggctgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaa

SEQ ID NO: 307693 - DNA, 1127 bp, Homo sapiens
gtgggcggtcccaggcaggcccagaagctgggcagcctctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaaggaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagcctttgggctgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaaaccagaaagaactctgaccaaacccgccagacattacggacaaacaagggggggggccggcttcaagaaaacccg

SEQ ID NO: 307694 - DNA, 1367 bp, Homo sapiens
gtgggcggtcccaggcaggcccagaagctgggcagcctctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaagggtgaagagagtgggatgtagacagggtatccagtgaaaaacacagaagtcggagattgagggattgataggatggaggggctgcgggagactaaagcaagtgaagcctgccttgggaaacctcaggatcagccttgagcgagctgaaggttgccgggcatgaaagggaagaagagcaggcaaataggtcatgggaaccttgggtgagaggctgagggcggaggagctctgggggatgtcagaagcaaggaagagctagtcctccaccaggaaagcagcaagaggagccctgcctctgggtgcctctgccccacagaagtttgtctgccatgcgtttcctcaccgccgtgaacttggagcatccagagatgctggagaaagcgtcccgggagctgtggatgcgcgtctggtcaaggaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagcctttgggctgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaa

SEQ ID NO: 307695 - DNA, 1452 bp, Homo sapiens
gtgggcggtcccaggcaggcccagaagctgggcagcctctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaaggaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagcctttgggctgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaaaaaaaaaaaaaaaaataaaaaaaacaaaggggggggggggaaaaaaggtatccctagaggggcaccagatatatacgcgtgataccaacattattttgtacacaaggtgggcgccatatagaggagcgcgatataataagagcagtcgcaatggcccaggagttttaaaaacgtgcgacacggtgacacagctgctacggggggagcttgtggaggagagaccctaaatcgtgttgtagggggcacaaggtggagaacaataaactaaaagaaattttaaaaggctagaggggaagtatagaaaattgaaggggtaaaagtgggttaaacataggtgatatttgtggggcggatgagaagtatggggtagtggggtataagatttgacacgttttatcgg

SEQ ID NO: 307696 - DNA, 1535 bp, Homo sapiens
gtgggcggtcccaggcaggcccagaagctgggcagcctctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaagggtgaagagagtgggatgtagacagggtatccagtgaaaaacacagaagtcggagattgagggattgataggatggaggggctgcgggagactaaagcaagtgaagcctgccttgggaaacctcaggatcagccttgagcgagctgaaggttgccgggcatgaaagggaagaagagcaggcaaataggtcatgggaaccttgggtgagaggctgagggcggaggagctctgggggatgtcagaagcaaggaagagctagtcctccaccaggaaagcagcaagaggagccctgcctctgggtgcctctgccccacagaagtttgtctgccatgcgtttcctcaccgccgtgaacttggagcatccagagatgctggagaaagcgtcccgggagctgtggatgcgcgtctggtcaagggtgagtgtggggctctgggaatcctctgggaggaccttggatgactttctgaccttccccaggcacgttttcagggtcatgatcctgcccccgcccgggggatctactgtcctcccagtcacacccctctccccgcaccgccttcctgctgtcttctcttcttcccagaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagcctttgggctgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaa

SEQ ID NO: 307697 - DNA, 1167 bp, Homo sapiens
gtgggcggtcccaggcaggcccagaagctgggcagcctctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaagatgctggagaaagcgtcccgggagctgtggatgcgcgtctggtcaagggtgagtgtggggctctgggaatcctctgggaggaccttggatgactttctgaccttccccaggcacgttttcagggtcatgatcctgcccccgcccgggggatctactgtcctcccagtcacacccctctccccgcaccgccttcctgctgtcttctcttcttcccagaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagcctttgggctgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaa

SEQ ID NO: 307698 - DNA, 1884 bp, Homo sapiens
tgagtaggacacggcgaccgtgtattatacaggcaggttactgaactagtgggcgtggcgacaatctgagaaaaggagctcctgctgccactgctcttccggagcctgcagcatggggcccctgccgcgcaccgtggagctcttctatgacgtgctgtccccctactcctggctgggcttcgaggtgacgctgggaggggtcgcctcggcagtgtctggggagtgagggcggagggaagagtgagcgcagggctccgggacagaggtctcgtgtaactcctggcgccgcccaaggggttaaggcaagcagggagagctccggggctgaaggtcactttgtgcttttaaacggaatagagtcgctggctccaacccgagcctttatatcccgactgcagtttcccacggtggtggaaagaggggcggctccaaacattcagggagaaatgcagaacacggccacctcttagcccaacgatggcagttttggggaaaactggccacaggagcgaagatcctggaatagatttctagtagtgaggagagttttgccaatttcaaaccaaacaatgtagggtgtccgcataacccctgctctgcacttagcgcctcccttccctttccctcggctctttcacttttccatcttgcacactggcaatcgttcttgacctctgcccgcagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaagggtgaagagagtgggatgtagacagggtatccagtgaaaaacacagaagtcggagattgagggattgataggatggaggggctgcgggagactaaagcaagtgaagcctgccttgggaaacctcaggatcagccttgagcgagctgaaggttgccgggcatgaaagggaagaagagcaggcaaataggtcatgggaaccttgggtgagaggctgagggcggaggagctctgggggatgtcagaagcaaggaagagctagtcctccaccaggaaagcagcaagaggagccctgcctctgggtgcctctgccccacagaagtttgtctgccatgcgtttcctcaccgccgtgaacttggagcatccagagatgctggagaaagcgtcccgggagctgtggatgcgcgtctggtcaaggaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagcctttgggctgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaa

SEQ ID NO: 307699 - DNA, 1016 bp, Homo sapiens
gtgggcggtcccaggcaggcccagaagctgggcagcctctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaagggctgcagagaaggctggtatgtctgcagaacaagcccagggacttctggaaaagatcgcaacgccaaaggtgaagaaccagctcaaggagaccactgaggcagcctgcagatacggagcctttgggctgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaa

SEQ ID NO: 307700 - DNA, 1170 bp, Homo sapiens
  misc_feature (341)..(341): n is a, c, g, or t
  misc_feature (587)..(587): n is a, c, g, or t
tgagtaggacacggcgaccgtgtattatacaggcaggttactgaactagtgggcgtggcgacaatctgagaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttttaaaaaggcctttcccccnttggaaaaggaaccaaaccccaattcttcccaaggaatttcccccaattccaatttccccaaaggaattcctgtgtctgtagatgcttgaaaacaggacagttgtgtccgtgccactagttggggcccgctttttcatcctcctacacgccgcgcgtgacacttggacgcatccagagtatgctggagaaagcgtcccgggagctgtggactgcgcgtctggtcaaggaatgaacgacatttcaanccccgggaagggccccccgggccaaagaaagcccatccctgggctggctgcagagaaggctggtatgtctgcagaacaagcccagggacttctggaaaagatcgcaacgccaaaggtgaagaaccagctcaaggagaccactgaggcagcctgcagatacggagcctttgggctgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaa

SEQ ID NO: 307701 - DNA, 656 bp, Homo sapiens
ccgcagggtagaagcccagggcccagcacctcagggtggcctcatggtcagagatggggtggtgggtcacatgtgactcaggggtgcccactgactttgcgccgcagagcatcctggcggctgcagagaaggctggtatgtctgcagaacaagcccagggacttctggaaaagatcgcaacgccaaaggtgaagaaccagctcaaggagaccactgaggcagcctgcagatacggagcctttgggctgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaa

SEQ ID NO: 307702 - DNA, 1409 bp, Homo sapiens
gtgggcggtcccaggcaggcccagaagctgggcagcctctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaaggaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagtgagcagctctttatgtgtgttcccagcacccatcctgaagatggagacttgagaatctctaagtttgagtccttatgctcctgtacaaaagccccctttccaagtgttctcctcagtgctcttaaacaaccctcatcttcttccttcttttccttgggctcagggaaaggaagggaaggagatgcacagtgagagaaaagagagcatcttagaaacaggaaggcacctggggccacagagcctcttagacctctttgcttctgtgaactcagaaaagtactgactcaaaggtttcaacccctgcctaatacctgctcctttgccttcctccttgcattgtaactgctttctccaggcctttgggctgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaa

SEQ ID NO: 307703 - DNA, 995 bp, Homo sapiens
gtgggcggtcccaggcaggcccagaagctgggcagcctctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaaggaatgaagacatcaccgagccgcagagcatcctggcggctgcagagaaggctggtatgtctgcagaacaagcccagggacttctggaaaagatcgcagcctttgggctgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaa

SEQ ID NO: 307704 - DNA, 1577 bp, Homo sapiens
gtgggcggtcccaggcaggcccagaagctgggcagcctctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaagggtgagtgtggggctctgggaatcctctgggaggaccttggatgactttctgaccttccccaggcacgttttcagggtcatgatcctgcccccgcccgggggatctactgtcctcccagtcacacccctctccccgcaccgccttcctgctgtcttctcttcttcccagaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagtgagcagctctttatgtgtgttcccagcacccatcctgaagatggagacttgagaatctctaagtttgagtccttatgctcctgtacaaaagccccctttccaagtgttctcctcagtgctcttaaacaaccctcatcttcttccttcttttccttgggctcagggaaaggaagggaaggagatgcacagtgagagaaaagagagcatcttagaaacaggaaggcacctggggccacagagcctcttagacctctttgcttctgtgaactcagaaaagtactgactcaaaggtttcaacccctgcctaatacctgctcctttgccttcctccttgcattgtaactgctttctccaggcctttgggctgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaa

SEQ ID NO: 307705 - DNA, 1459 bp, Homo sapiens
gtgggcggtcccaggcaggcccagaagctgggcagcctctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaaggaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagtgagcagctctttatgtgtgttcccagcacccatcctgaagatggagacttgagaatctctaagtttgagtccttatgctcctgtacaaaagccccctttccaagtgttctcctcagtgctcttaaacaaccctcatcttcttccttcttttccttgggctcagggaaaggaagggaaggagatgcacagtgagagaaaagagagcatcttagaaacaggaaggcacctggggccacagagcctcttagacctctttgcttctgtgaactcagaaaagtactgactcaaaggtttcaacccctgcctaatacctgctcctttgccttcctccttgcattgtaactgctttctccaggcctttgggctgcccatcaccgtggcccatgtggatggccaaacccacatgttatttggctctgaccggatggagctgctggcgcacctgctgggtaagtaagttaaagaatcaaccctgagccaggtgcagtggctcacgcctgtaatcccagcactttggtaggctgaggcgagcagagcacgagttcaggagattaagaccatcctggccaacatggtgaaaccccgtctctactaaaaatataaaaattagctgggactacagctgcctcagtgggaggctgaggcaggagaatcacttgaacctgggaggcggaggttgcagtgagccgagatcgcgccactgcactccagcctgggtgacaaagcaagactccgtctcaaaataaaaagattcaaccctgagctgcctttgaccccagctccacacccactatatcagttgaccagaaggaggggctcagagca

SEQ ID NO: 307706 - DNA, 1449 bp, Homo sapiens
gtgggcggtcccaggcaggcccagaagctgggcagcctctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaaggaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagtgagcagctctttatgtgtgttcccagcacccatcctgaagatggagacttgagaatctctaagtttgagtccttatgctcctgtacaaaagccccctttccaagtgttctcctcagtgctcttaaacaaccctcatcttcttccttcttttccttgggctcagggaaaggaagggaaggagatgcacagtgagagaaaagagagcatcttagaaacaggaaggcacctggggccacagagcctcttagacctctttgcttctgtgaactcagaaaagtactgactcaaaggtttcaacccctgcctaatacctgctcctttgccttcctccttgcattgtaactgctttctccaggcctttgggctgcccatcaccgtggcccatgtggatggccaaacccacatgttatttggctctgaccggatggagctgctggcgcacctgctgggtaagtaagttaaagaatcaaccctgagccaggtgcagtggctcacgcctgtaatcccagcactttggtaggctgaggcgagcagagcacgagttcaggagattaagaccatcctggccaacatggtgaaaccccgtctctactaaaaatataaaaattagctgggactacagctgcctcagtgggaggctgaggcaggagaatcacttgaacctgggaggcggaggttgcagtgagccgagatcgcgccactgcactccagcctgggtgacaaagcaagactccgtctcaaaataaaaagattcccggggtggcttttaccccagttacaaccacttttttttgcccccaggagggggttatgcc

SEQ ID NO: 307707 - DNA, 1405 bp, Homo sapiens
gtgggcggtcccaggcaggcccagaagctgggcagcctctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaaggaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagtgagcagctctttatgtgtgttcccagcacccatcctgaagatggagacttgagaatctctaagtttgagtccttatgctcctgtacaaaagccccctttccaagtgttctcctcagtgctcttaaacaaccctcatcttcttccttcttttccttgggctcagggaaaggaagggaaggagatgcacagtgagagaaaagagagcatcttagaaacaggaaggcacctggggccacagagcctcttagacctctttgcttctgtgaactcagactccttgcattgtaactgctttctccaggcctttgggctgcccatcaccgtggcccatgtggatggccaaacccacatgttatttggctctgaccggatggagctgctggcgcacctgctgggtaagtaagttaaagaatcaaccctgagccaggtgcagtggctcacgcctgtaatcccagcactttggtaggctgaggcgagcagagcacgagttcaggagattaagaccatcctggccaacatggtgaaaccccgtctctactaaaaatataaaaattagctgggactacagctgcctcagtgggaggctgaggcaggagaatcacttgaacctgggaggcggaggttgcagtgagccgagatcgcgccactgcactccagcctgggtgacaaagcaagactccgtctcaaaataaaaagattcaaccctgagctgcctttgaccccagctccacacccactatatcagttgaccagaaggaggggctcagagca

SEQ ID NO: 307708 - DNA, 928 bp, Homo sapiens
gtgggcggtcccaggcaggcccagaagctgggcagcctctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaaggaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagtgagcagctctttatgtgtgttcccagcacccatcctgaagatggagacttgagaatctctaagtttgagtccttatgctcctgtacaaaagccccctttccaagtgttctcctcagtgctcttaaacaaccctcatcttcttccttcttttccttgggctcagggaaaggaagggaaggagatgcacagtgagagaaaagagagcatcttagaaagggggcttttgtacaggagcataaggactcgacttagagattctcaagtctccatcttcacggatgggatcctctagat

SEQ ID NO: 307709 - DNA, 1236 bp, Homo sapiens
gtgggcggtcccaggcaggcccagaagctgggcagcctctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaaggaatgaagacatcaccgagccgcagagcatcctggcggtgagtgtcctggctccaccccaactgcactcatagagaatctgagaacagttggcgtttgggggtaaagaagacaataggtctcttattgcatggaaaaggttataattactggggaagaaaggatgtctgtgattcagggcacaaactactgaaaagttggaactaaggatcctcaaaaggatatctcaaggttgaaaggggaagtgcaaaagggacaatatatgggaagaatttatttgctgaaagatgtcagtgagagaaagatgctcagtgttggaacccctggatggggagggatatagtattcacaagtctccacaaactccaacacaaacctcaccaacacatccagagtggaaggcaggagacttgttccaagaggctttaaaaagacgaaaagagataactaatgccagggttatataggagcctgagtgagaacaaatggaaatagctcaaaacattgaccagtgagccatggatgggggtataaaagtaagtttgtcttcaggattaaattaggaaattcaaaacagtattattcctctggtttacaaaaaaaaatagttgagacctattcaaatttaatatataaagtggcaaatcacacaaaagttaaacgtataaggaatggcaaatatatcttctacagtctatactcctgcaaagtacatgtgtaatttttagcttgcttttttacttcatatttaatcatttt

SEQ ID NO: 307710 - DNA, 1404 bp, Homo sapiens
gtgggcggtcccaggcaggcccagaagctgggcagcctctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaagggtgagtgtggggctctgggaatcctctgggaggaccttggatgactttctgaccttccccaggcacgttttcagggtcatgatcctgcccccgcccgggggatctactgtcctcccagtcacacccctctccccgcaccgccttcctgctgtcttctcttcttcccagaatgaagacatcaccgagccgcagagcatcctggcggtgagtgtcctggctccaccccaactgcactcatagagaatctgagaacagttggcgtttgggggtaaagaagacaataggtctcttattgcatggaaaaggttataattactggggaagaaaggatgtctgtgattcagggcacaaactactgaaaagttggaactaaggatcctcaaaaggatatctcaaggttgaaaggggaagtgcaaaagggacaatatatgggaagaatttatttgctgaaagatgtcagtgagagaaagatgctcagtgttggaacccctggatggggagggatatagtattcacaagtctccacaaactccaacacaaacctcaccaacacatccagagtggaaggcaggagacttgttccaagaggctttaaaaagacgaaaagagataactaatgccagggttatataggagcctgagtgagaacaaatggaaatagctcaaaacattgaccagtgagccatggatgggggtataaaagtaagtttgtcttcaggattaaattaggaaattcaaaacagtattattcctctggtttacaaaaaaaaatagttgagacctattcaaatttaatatataaagtggcaaatcacacaaaagttaaacgtataaggaatggcaaatatatcttctacagtctatactcctgcaaagtacatgtgtaatttttagcttgcttttttacttcatatttaatcatttt

SEQ ID NO: 307711 - DNA, 968 bp, Homo sapiens
tgagtaggacacggcgaccgtgtattatacaggcaggttactgaactagtgggcgtggcgacaatctgagaaaaggagctcctgctgccactgctcttccggagcctgcagcatggggcccctgccgcgcaccgtggagctcttctatgacgtgctgtccccctactcctggctgggcttcgaggtgacgctgggaggggtcgcctcggcagtgtctggggagtgagggcggagggaagagtgagcgcagggctccgggacagaggtctcgtgtaactcctggcgccgcccaaggggttaaggcaagcagggagagctccggggctgaaggtcactttgtgcttttaaacggaatagagtcgctggctccaacccgagcctttatatcccgactgcagtttcccacggtggtggaaagaggggcggctccaaacattcagggagaaatgcagaacacggccacctcttagcccaacgatggcagttttggggaaaactggccacaggagcgaagatcctggaatagatttctagtagtgaggagagttttgccaatttcaaaccaaacaatgtagggtgtccgcataacccctgctctgcacttagcgcctcccttccctttccctcggctctttcacttttccatcttgcacactggcaatcgttcttgacctctgcccgcagatcctgtgccggtatcagaatatctggaacatcaacctgcagttgcggcccagcctcataacagggatcatgaaagacagtggtaggaagggagggtcggggcaggggtgatctcagtggcccaagagagccgaccccagcgggtccttatattggcactggcagccagaaagctgccctctgccccgtctctactaaaaatacaaaattagccgggcgtggtagtgcatgcctgtataccacagctactcgggaggctgaggcgggagaatcgcttgaaccca

SEQ ID NO: 307712 - DNA, 6631 bp, Homo sapiens
agggaaggttggcagagggatccatgtgactgaggccggagcacggcaaagatgagcctgcccgcccgcctgctgcctggatgcggagggtgagggctggcgcacgggaggccgctggctgcgcattctgggcgccgagtgcccgggatgagctcacgcccgcgtctgcggctctctccacctgccgacctgccgggggcccactgagctgacggcgcacctgggctccggccgcagcgtggggcgcggcgcccgggagcaggtgtgcaggagcgcagcgcgcggcgagcgcagccctcgctccggagcccggccgcgccgcgtgcccgggcggctaggcagcggcggcggcggcggcgggcggcgggcgggcggcggcccccgggcaggtgccgagcggcgagcggagccgggccgggcggagcgcggggggcgaggccggcgcgtcgctcgcgggaggccggggagcggcaggggcatgtggatactggctctctccttgttccagagcttcgcgaatgttttcagtgaagacctacactccagcctctactttgtcaatgcatctctgcaagaggtagtgtttgccagcaccacggggactctggtgccctgccccgcagcaggcatccctcctgtgactctcagatggtacctagccacgggcgaggagatctacgatgtccccgggatccgccacgtccaccccaacggcactctccaaattttccccttccctccttcaagcttcagtaccttaatccatgataatacttattattgcacagctgaaaatccttcagggaaaattagaagtcaggatgtccacatcaaggctgttttacgggagccctatacagtccgtgtggaggaccagaaaaccatgagaggcaatgttgcggtcttcaagtgcattatcccctcctcggtggaggcgtacatcactgtcgtctcatgggagaaagacactgtttcacttgtctcaggatctagatttctcatcacatccacgggagccttgtatattaaagatgtacagaatgaagatggattgtataactaccgctgcatcacgcggcatcgatacaccggagagacgaggcagagcaacagcgccagactttttgtatcagacccagcgaactcagccccatccatactggatgggtttgaccatcgcaaagccatggctgggcagcgtgtggagctgccttgcaaagcgctcgggcaccctgagccagattaccgctggctgaaggacaacatgcccctggaactttcagggaggttccagaagaccgtgacggggctgctcattgagaacattcgcccctcggactcaggcagctatgtttgtgaagtgtccaacagatacggaactgctaaggtgataggccgcctgtacgtgaaacagccactgaaagccaccatcagtcccaggaaggttaaaagcagcgtgggtagccaagtttccttgtcctgcagcgtgacaggaactgaggaccaggaactctcctggtaccgcaatggtgaaatcctcaaccctggaaaaaatgtgaggatcacagggatcaaccacgaaaaccttataatggatcacatggtcaaaagtgacgggggcgcataccagtgctttgtgcgcaaggacaagctgtccgctcaagactatgtgcaggtggtccttgaagatggaactcccaaaattatttctgcctttagtgaaaaggtggtgagtccagcagagccggtttcccttatgtgcaacgtgaagggaacacctttgcccacgatcacgtggaccctggacgatgacccgattctcaagggtggcagtcaccgcatcagccagatgatcacgtcggaggggaacgtggtcagctacctgaacatctccagctcccaggtccgggacgggggagtctaccgctgcactgccaacaactcggcgggagtcgtcctgtaccaggctcgaataaacgtaagagggcctgcaagcattcgaccaatgaaaaacatcacagcaatagcaggacgggacacatacattcactgtcgtgtgattggctatccgtattactccattaaatggtacaagaactctaacctgcttcctttcaaccaccgccaagtggcatttgagaacaatggaactcttaaactttcagatgtgcaaaaggaagtggacgagggggagtacacgtgcaacgtgttggttcaaccacaactctccaccagccagagcgtccacgtgaccgtgaaagttccgcctttcatacaaccctttgagtttccaagattctccattgggcagcgggtcttcatcccctgtgttgtggtctcaggggacttacccatcacgatcacctggcagaaggatggccggccaatccctgggagccttggggtgaccattgacaatattgacttcacgagctccttgaggatttccaatctctcgctcatgcacaatgggaattacacctgcatagcccggaatgaggccgccgctgtggagcaccaaagccagttgattgtcagagttcctcccaagtttgtggttcagccacgggaccaggacgggatttatggcaaagcagtcatcctcaattgttctgctgagggttaccctgtacctaccatcgtgtggaaattctctaaaggtgctggggttccccagttccagccaattgccctaaatggccgaatccaagttctcagcaatgggtcgttgctgatcaagcatgtcgtggaggaagacagtggctactacctctgcaaggtcagcaacgatgtgggcgcagacgtcagcaagtccatgtacctcacggttaaaattcctgcgatgataacatcctatccaaatactaccctggccacgcaggggcagaaaaaggagatgagctgcacggcgcatggtgagaagcccattatagtccgctgggagaaggaggaccgaatcattaaccctgagatggcccgttatcttgtgtccaccaaggaggtgggagaagaggtgatttctactctgcagattttgccaactgtgagagaagattctggtttcttttcctgccatgctattaattcttatggggaggaccgtggaataattcagctcacagtgcaagagcccccagaccctcccgaaattgagatcaaagatgtcaaagcacgcacaattacgctcaggtggaccatggggtttgatggaaacagtcccatcacaggctacgatattgaatgcaaaaataaatcagactcctgggattctgctcagagaaccaaagatgtttcccctcagctgaactcggccaccatcattgatatccacccttcctccacctacagcatccgcatgtacgccaagaaccggattggcaagagcgagcccagcaacgagctcaccatcacggcggacgaggcagctcctgatggtccacctcaggaagttcacctggagcctatatcatctcagagcatcagggtcacatggaaggctcccaagaaacatttgcaaaatgggattatccgtggctaccaaataggttaccgagagtacagcactgggggtaacttccaattcaacattatcagtgtcgacaccagcggggacagtgaggtttacaccctggacaacctgaataagttcactcagtacggcctggtggtgcaggcctgtaaccgggccggcacggggccttcttctcaggaaatcatcaccaccactctcgaggatgtgcccagttacccccccgaaaatgtccaagccatagcaacatcaccagaaagcatatcaatatcctggtccacactttccaaggaagccttgaatggaattctccaggggttcagagtcatttactgggccaacctcatggacggagagctgggtgagattaaaaacatcaccaccacacagccttcactggagctggacgggctggaaaagtacaccaactacagcatccaggtgctggccttcacccgcgcaggagacggggtcaggagtgagcagatcttcacccggaccaaagaggatgttccaggtcctcccgcgggtgtgaaggcagcggcggcctcagcctccatggtctttgtgtcctggcttccccctctcaagctgaacggcatcatccgaaagtacactgtattctgctcccacccctatcccacagtgatcagcgagtttgaggcctctcccgactcgttttcctacagaattcccaacctgagtaggaatcgtcagtacagcgtctgggtggtggctgttacttcagccggaagaggcaacagcagtgaaatcatcacagtcgagccactagcaaaagctcctgcacgaatcctgaccttcagtgggacagtgactactccatggatgaaagacattgtcttgccttgtaaggctgttggggacccttctcctgcagtcaaatggatgaaagacagtaacgggacacccagtctagtaacgattgatgggcggaggagcatctttagcaacggaagcttcattattcgcacggtgaaagcagaagactccggctattacagctgcattgccaataacaactggggatctgatgaaattattttaaacttacaagtacaagttccaccagatcagcctcggcttacagtctccaagaccacgtcttcctccatcaccctttcttggctccctggagacaacgggggcagctctatcagaggatacatactgcagtactccgaggacaatagtgagcagtgggggagttttccaatcagccccagcgaacgttcctatcgcttggaaaatctcaaatgtgggacttggtataagttcacactgacagcccaaaatggagtgggcccagggcgcataagtgaaatcatagaagcaaagaccttaggaaaagagccccagttctcaaaggagcaggagctgtttgccagcatcaacaccacacgcgtgaggctgaacctcattggctggaatgatggcggctgccccatcacctccttcacactagagtacaggccctttgggaccacagtttggaccacagctcagaggacctctctctccaagtcctacatcctgtatgacctgcaggaagccacctggtatgagctgcagatgcgggtgtgcaacagtgcgggctgcgcggagaagcaggccaacttcgctacgctgaactacgatggcagtacaattcctccactcattaagtcagttgtccaaaacgaagaagggctgacgaccaacgaggggctcaagatgctggtgaccatctcctgtatcctggtgggggtcttgctgctgtttgtgctcctgctggttgtgcggaggaggcggcgggagcagaggctaaagaggctgcgagatgcaaagagtttagctgaaatgctcatgagtaagaatacccggacttcagatacgttaagcaagcaacagcagaccctgcgaatgcacatcgacatacccagggctcagcttttgattgaagagagagacacgatggagaccattgatgatcgctccacggttctgttgacggatgctgactttggagaggcagctaagcagaagtccctgacggtcactcacacggtccattaccaatcggtgtctcaggccactgggcccttagtggatgtttcagacgctcggccgggaacgaatcccaccaccaggaggaatgccaaggctgggcccacagcgagaaaccgctatgccagccagtggaccctcaaccgaccccaccccaccatctcagcacacaccctcaccacagactggaggctgccaacacccagggctgcaggatcagtagacaaagagagcgacagttacagcgtcagcccctcgcaagacacagatcgagcaagaagcagcatggtctccacagaaagtgcctcctccacttacgaagaactggccagggcctacgaacacgccaagatggaagagcaactgaggcacgccaagttcaccatcacggagtgcttcatatcagacacgtcatcggagcagttgacggcagggacaaatgagtacacggacagtctgacctccagcaccccttccgaatcgggaatctgcaggttcactgcatctccccccaaacctcaggatggaggaagagtaatgaatatggcagttccaaaggcacatcggccaggtgacctcatacatttgcctccataccttagaatggactttttgttaaaccgaggtggtccaggcaccagcagggacctgagcttaggacaagcatgcttggaacctcagaaaagccggaccctgaagcgccccacggtcctggagcccatcccgatggaagccgcctcctccgcctcctccacgagagaaggacagtcgtggcagccgggggccgtggccacattacctcagcgggagggagcagagctgggacaggcagctaaaatgagcagctcccaagaatcactgctcgactcccggggccatttgaaaggaaacaatccttacgcaaaatcttacaccctggtataacagacagcatgactggacagcggttgtaaatacaattcaaacaattcaatcaaagctaccttttttttacggaattccaatatttataattaaagaaaattgccaaaatatatt

SEQ ID NO: 307713 - DNA, 6454 bp, Homo sapiens
agggaaggttggcagagggatccatgtgactgaggccggagcacggcaaagatgagcctgcccgcccgcctgctgcctggatgcggagggtgagggctggcgcacgggaggccgctggctgcgcattctgggcgccgagtgcccgggatgagctcacgcccgcgtctgcggctctctccacctgccgacctgccgggggcccactgagctgacggcgcacctgggctccggccgcagcgtggggcgcggcgcccgggagcaggtgtgcaggagcgcagcgcgcggcgagcgcagccctcgctccggagcccggccgcgccgcgtgcccgggcggctaggcagcggcggcggcggcggcgggcggcgggcgggcggcggcccccgggcaggtgccgagcggcgagcggagccgggccgggcggagcgcggggggcgaggccggcgcgtcgctcgcgggaggccggggagcggcaggggcatgtggatactggctctctccttgttccagagcttcgcgaatgttttcagtgaagacctacactccagcctctactttgtcaatgcatctctgcaagaggtagtgtttgccagcaccacggggactctggtgccctgccccgcagcaggcatccctcctgtgactctcagatggtacctagccacgggcgaggagatctacgatgtccccgggatccgccacgtccaccccaacggcactctccaaattttccccttccctccttcaagcttcagtaccttaatccatgataatacttattattgcacagctgaaaatccttcagggaaaattagaagtcaggatgtccacatcaaggctgttttacgggagccctatacagtccgtgtggaggaccagaaaaccatgagaggcaatgttgcggtcttcaagtgcattatcccctcctcggtggaggcgtacatcactgtcgtctcatgggagaaagacactgtttcacttgtctcaggatctagatttctcatcacatccacgggagccttgtatattaaagatgtacagaatgaagatggattgtataactaccgctgcatcacgcggcatcgatacaccggagagacgaggcagagcaacagcgccagactttttgtatcagacccagcgaactcagccccatccatactggatgggtttgaccatcgcaaagccatggctgggcagcgtgtggagctgccttgcaaagcgctcgggcaccctgagccagattaccgctggctgaaggacaacatgcccctggaactttcagggaggttccagaagaccgtgacggggctgctcattgagaacattcgcccctcggactcaggcagctatgtttgtgaagtgtccaacagatacggaactgctaaggtgataggccgcctgtacgtgaaacagccactgaaagccaccatcagtcccaggaaggttaaaagcagcgtgggtagccaagtttccttgtcctgcagcgtgacaggaactgaggaccaggaactctcctggtaccgcaatggtgaaatcctcaaccctggaaaaaatgtgaggatcacagggatcaaccacgaaaaccttataatggatcacatggtcaaaagtgacgggggcgcataccagtgctttgtgcgcaaggacaagctgtccgctcaagactatgtgcaggtggtccttgaagatggaactcccaaaattatttctgcctttagtgaaaaggtggtgagtccagcagagccggtttcccttatgtgcaacgtgaagggaacacctttgcccacgatcacgtggaccctggacgatgacccgattctcaagggtggcagtcaccgcatcagccagatgatcacgtcggaggggaacgtggtcagctacctgaacatctccagctcccaggtccgggacgggggagtctaccgctgcactgccaacaactcggcgggagtcgtcctgtaccaggctcgaataaacgtaagagggcctgcaagcattcgaccaatgaaaaacatcacagcaatagcaggacgggacacatacattcactgtcgtgtgattggctatccgtattactccattaaatggtacaagaactctaacctgcttcctttcaaccaccgccaagtggcatttgagaacaatggaactcttaaactttcagatgtgcaaaaggaagtggacgagggggagtacacgtgcaacgtgttggttcaaccacaactctccaccagccagagcgtccacgtgaccgtgaaagttccgcctttcatacaaccctttgagtttccaagattctccattgggcagcgggtcttcatcccctgtgttgtggtctcaggggacttacccatcacgatcacctggcagaaggatggccggccaatccctgggagccttggggtgaccattgacaatattgacttcacgagctccttgaggatttccaatctctcgctcatgcacaatgggaattacacctgcatagcccggaatgaggccgccgctgtggagcaccaaagccagttgattgtcagagttcctcccaagtttgtggttcagccacgggaccaggacgggatttatggcaaagcagtcatcctcaattgttctgctgagggttaccctgtacctaccatcgtgtggaaattctctaaaggtgctggggttccccagttccagccaattgccctaaatggccgaatccaagttctcagcaatgggtcgttgctgatcaagcatgtcgtggaggaagacagtggctactacctctgcaaggtcagcaacgatgtgggcgcagacgtcagcaagtccatgtacctcacggttaaaattcctgcgatgataacatcctatccaaatactaccctggccacgcaggggcagaaaaaggagatgagctgcacggcgcatggtgagaagcccattatagtccgctgggagaaggaggaccgaatcattaaccctgagatggcccgttatcttgtgtccaccaaggaggtgggagaagaggtgatttctactctgcagattttgccaactgtgagagaagattctggtttcttttcctgccatgctattaattcttatggggaggaccgtggaataattcagctcacagtgcaagagcccccagaccctcccgaaattgagatcaaagatgtcaaagcacgcacaattacgctcaggtggaccatggggtttgatggaaacagtcccatcacaggctacgatattgaatgcaaaaataaatcagactcctgggattctgctcagagaaccaaagatgtttcccctcagctgaactcggccaccatcattgatatccacccttcctccacctacagcatccgcatgtacgccaagaaccggattggcaagagcgagcccagcaacgagctcaccatcacggcggacgaggcagctcctgatggtccacctcaggaagttcacctggagcctatatcatctcagagcatcagggtcacatggaaggctcccaagaaacatttgcaaaatgggattatccgtggctaccaaataggttaccgagagtacagcactgggggtaacttccaattcaacattatcagtgtcgacaccagcggggacagtgaggtttacaccctggacaacctgaataagttcactcagtacggcctggtggtgcaggcctgtaaccgggccggcacggggccttcttctcaggaaatcatcaccaccactctcgaggatgtgcccagttacccccccgaaaatgtccaagccatagcaacatcaccagaaagcatatcaatatcctggtccacactttccaaggaagccttgaatggaattctccaggggttcagagtcatttactgggccaacctcatggacggagagctgggtgagattaaaaacatcaccaccacacagccttcactggagctggacgggctggaaaagtacaccaactacagcatccaggtgctggccttcacccgcgcaggagacggggtcaggagtgagcagatcttcacccggaccaaagaggatgttccaggtcctcccgcgggtgtgaaggcagcggcggcctcagcctccatggtctttgtgtcctggcttccccctctcaagctgaacggcatcatccgaaagtacactgtattctgctcccacccctatcccacagtgatcagcgagtttgaggcctctcccgactcgttttcctacagaattcccaacctgagtaggaatcgtcagtacagcgtctgggtggtggctgttacttcagccggaagaggcaacagcagtgaaatcatcacagtcgagccactagcaaaagctcctgcacgaatcctgaccttcagtgggacagtgactactccatggatgaaagacattgtcttgccttgtaaggctgttggggacccttctcctgcagtcaaatggatgaaagacagtaacgggacacccagtctagtaacgattgatgggcggaggagcatctttagcaacggaagcttcattattcgcacggtgaaagcagaagactccggctattacagctgcattgccaataacaactggggatctgatgaaattattttaaacttacaagtacaagttccaccagatcagcctcggcttacagtctccaagaccacgtcttcctccatcaccctttcttggctccctggagacaacgggggcagctctatcagaggatacatactgcagtactccgaggacaatagtgagcagtgggggagttttccaatcagccccagcgaacgttcctatcgcttggaaaatctcaaatgtgggacttggtataagttcacactgacagcccaaaatggagtgggcccagggcgcataagtgaaatcatagaagcaaagaccttaggaaaagagccccagttctcaaaggagcaggagctgtttgccagcatcaacaccacacgcgtgaggctgaacctcattggctggaatgatggcggctgccccatcacctccttcacactagagtacaggccctttgggaccacagtttggaccacagctcagaggacctctctctccaagtcctacatcctgtatgacctgcaggaagccacctggtatgagctgcagatgcgggtgtgcaacagtgcgggctgcgcggagaagcaggccaacttcgctacgctgaactacgatggcaatgcaaagagtttagctgaaatgctcatgagtaagaatacccggacttcagatacgttaagcaagcaacagcagaccctgcgaatgcacatcgacatacccagggctcagcttttgattgaagagagagacacgatggagaccattgatgatcgctccacggttctgttgacggatgctgactttggagaggcagctaagcagaagtccctgacggtcactcacacggtccattaccaatcggtgtctcaggccactgggcccttagtggatgtttcagacgctcggccgggaacgaatcccaccaccaggaggaatgccaaggctgggcccacagcgagaaaccgctatgccagccagtggaccctcaaccgaccccaccccaccatctcagcacacaccctcaccacagactggaggctgccaacacccagggctgcaggatcagtagacaaagagagcgacagttacagcgtcagcccctcgcaagacacagatcgagcaagaagcagcatggtctccacagaaagtgcctcctccacttacgaagaactggccagggcctacgaacacgccaagatggaagagcaactgaggcacgccaagttcaccatcacggagtgcttcatatcagacacgtcatcggagcagttgacggcagggacaaatgagtacacggacagtctgacctccagcaccccttccgaatcgggaatctgcaggttcactgcatctccccccaaacctcaggatggaggaagagtaatgaatatggcagttccaaaggcacatcggccaggtgacctcatacatttgcctccataccttagaatggactttttgttaaaccgaggtggtccaggcaccagcagggacctgagcttaggacaagcatgcttggaacctcagaaaagccggaccctgaagcgccccacggtcctggagcccatcccgatggaagccgcctcctccgcctcctccacgagagaaggacagtcgtggcagccgggggccgtggccacattacctcagcgggagggagcagagctgggacaggcagctaaaatgagcagctcccaagaatcactgctcgactcccggggccatttgaaaggaaacaatccttacgcaaaatcttacaccctggtataacagacagcatgactggacagcggttgtaaatacaattcaaacaattcaatcaaagctaccttttttttacggaattccaatatttataattaaagaaaattgccaaaatatatt

SEQ ID NO: 307714 - DNA, 7141 bp, Homo sapiens
agggaaggttggcagagggatccatgtgactgaggccggagcacggcaaagatgagcctgcccgcccgcctgctgcctggatgcggagggtgagggctggcgcacgggaggccgctggctgcgcattctgggcgccgagtgcccgggatgagctcacgcccgcgtctgcggctctctccacctgccgacctgccgggggcccactgagctgacggcgcacctgggctccggccgcagcgtggggcgcggcgcccgggagcaggtgtgcaggagcgcagcgcgcggcgagcgcagccctcgctccggagcccggccgcgccgcgtgcccgggcggctaggcagcggcggcggcggcggcgggcggcgggcgggcggcggcccccgggcaggtgccgagcggcgagcggagccgggccgggcggagcgcggggggcgaggccggcgcgtcgctcgcgggaggccggggagcggcaggggcatgtggatactggctctctccttgttccagagcttcgcgaatgttttcagtgaagacctacactccagcctctactttgtcaatgcatctctgcaagaggtagtgtttgccagcaccacggggactctggtgccctgccccgcagcaggcatccctcctgtgactctcagatggtacctagccacgggcgaggagatctacgatgtccccgggatccgccacgtccaccccaacggcactctccaaattttccccttccctccttcaagcttcagtaccttaatccatgataatacttattattgcacagctgaaaatccttcagggaaaattagaagtcaggatgtccacatcaaggctgttttacgggagccctatacagtccgtgtggaggaccagaaaaccatgagaggcaatgttgcggtcttcaagtgcattatcccctcctcggtggaggcgtacatcactgtcgtctcatgggagaaagacactgtttcacttgtctcaggatctagatttctcatcacatccacgggagccttgtatattaaagatgtacagaatgaagatggattgtataactaccgctgcatcacgcggcatcgatacaccggagagacgaggcagagcaacagcgccagactttttgtatcagacccagcgaactcagccccatccatactggatgggtttgaccatcgcaaagccatggctgggcagcgtgtggagctgccttgcaaagcgctcgggcaccctgagccagattaccgctggctgaaggacaacatgcccctggaactttcagggaggttccagaagaccgtgacggggctgctcattgagaacattcgcccctcggactcaggcagctatgtttgtgaagtgtccaacagatacggaactgctaaggtgataggccgcctgtacgtgaaacagccactgaaagccaccatcagtcccaggaaggttaaaagcagcgtgggtagccaagtttccttgtcctgcagcgtgacaggaactgaggaccaggaactctcctggtaccgcaatggtgaaatcctcaaccctggaaaaaatgtgaggatcacagggatcaaccacgaaaaccttataatggatcacatggtcaaaagtgacgggggcgcataccagtgctttgtgcgcaaggacaagctgtccgctcaagactatgtgcaggtggtccttgaagatggaactcccaaaattatttctgcctttagtgaaaaggtggtgagtccagcagagccggtttcccttatgtgcaacgtgaagggaacacctttgcccacgatcacgtggaccctggacgatgacccgattctcaagggtggcagtcaccgcatcagccagatgatcacgtcggaggggaacgtggtcagctacctgaacatctccagctcccaggtccgggacgggggagtctaccgctgcactgccaacaactcggcgggagtcgtcctgtaccaggctcgaataaacgtaagagggcctgcaagcattcgaccaatgaaaaacatcacagcaatagcaggacgggacacatacattcactgtcgtgtgattggctatccgtattactccattaaatggtacaagaactctaacctgcttcctttcaaccaccgccaagtggcatttgagaacaatggaactcttaaactttcagatgtgcaaaaggaagtggacgagggggagtacacgtgcaacgtgttggttcaaccacaactctccaccagccagagcgtccacgtgaccgtgaaagttccgcctttcatacaaccctttgagtttccaagattctccattgggcagcgggtcttcatcccctgtgttgtggtctcaggggacttacccatcacgatcacctggcagaaggatggccggccaatccctgggagccttggggtgaccattgacaatattgacttcacgagctccttgaggatttccaatctctcgctcatgcacaatgggaattacacctgcatagcccggaatgaggccgccgctgtggagcaccaaagccagttgattgtcagagttcctcccaagtttgtggttcagccacgggaccaggacgggatttatggcaaagcagtcatcctcaattgttctgctgagggttaccctgtacctaccatcgtgtggaaattctctaaaggtgctggggttccccagttccagccaattgccctaaatggccgaatccaagttctcagcaatgggtcgttgctgatcaagcatgtcgtggaggaagacagtggctactacctctgcaaggtcagcaacgatgtgggcgcagacgtcagcaagtccatgtacctcacggttaaaattcctgcgatgataacatcctatccaaatactaccctggccacgcaggggcagaaaaaggagatgagctgcacggcgcatggtgagaagcccattatagtccgctgggagaaggaggaccgaatcattaaccctgagatggcccgttatcttgtgtccaccaaggaggtgggagaagaggtgatttctactctgcagattttgccaactgtgagagaagattctggtttcttttcctgccatgctattaattcttatggggaggaccgtggaataattcagctcacagtgcaagagcccccagaccctcccgaaattgagatcaaagatgtcaaagcacgcacaattacgctcaggtggaccatggggtttgatggaaacagtcccatcacaggctacgatattgaatgcaaaaataaatcagactcctgggattctgctcagagaaccaaagatgtttcccctcagctgaactcggccaccatcattgatatccacccttcctccacctacagcatccgcatgtacgccaagaaccggattggcaagagcgagcccagcaacgagctcaccatcacggcggacgaggcagctcctgatggtccacctcaggaagttcacctggagcctatatcatctcagagcatcagggtcacatggaaggctcccaagaaacatttgcaaaatgggattatccgtggctaccaaataggttaccgagagtacagcactgggggtaacttccaattcaacattatcagtgtcgacaccagcggggacagtgaggtttacaccctggacaacctgaataagttcactcagtacggcctggtggtgcaggcctgtaaccgggccggcacggggccttcttctcaggaaatcatcaccaccactctcgaggatgtgcccagttacccccccgaaaatgtccaagccatagcaacatcaccagaaagcatatcaatatcctggtccacactttccaaggaagccttgaatggaattctccaggggttcagagtcatttactgggccaacctcatggacggagagctgggtgagattaaaaacatcaccaccacacagccttcactggagctggacgggctggaaaagtacaccaactacagcatccaggtgctggccttcacccgcgcaggagacggggtcaggagtgagcagatcttcacccggaccaaagaggatgttccaggtcctcccgcgggtgtgaaggcagcggcggcctcagcctccatggtctttgtgtcctggcttccccctctcaagctgaacggcatcatccgaaagtacactgtattctgctcccacccctatcccacagtgatcagcgagtttgaggcctctcccgactcgttttcctacagaattcccaacctgagtaggaatcgtcagtacagcgtctgggtggtggctgttacttcagccggaagaggcaacagcagtgaaatcatcacagtcgagccactagcaaaagctcctgcacgaatcctgaccttcagtgggacagtgactactccatggatgaaagacattgtcttgccttgtaaggctgttggggacccttctcctgcagtcaaatggatgaaagacagtaacgggacacccagtctagtaacgattgatgggcggaggagcatctttagcaacggaagcttcattattcgcacggtgaaagcagaagactccggctattacagctgcattgccaataacaactggggatctgatgaaattattttaaacttacaagtacaagttccaccagatcagcctcggcttacagtctccaagaccacgtcttcctccatcaccctttcttggctccctggagacaacgggggcagctctatcagaggatacatactgcagtactccgaggacaatagtgagcagtgggggagttttccaatcagccccagcgaacgttcctatcgcttggaaaatctcaaatgtgggacttggtataagttcacactgacagcccaaaatggagtgggcccagggcgcataagtgaaatcatagaagcaaagaccttaggaaaagagccccagttctcaaaggagcaggagctgtttgccagcatcaacaccacacgcgtgaggctgaacctcattggctggaatgatggcggctgccccatcacctccttcacactagagtacaggccctttgggaccacagtttggaccacagctcagaggacctctctctccaagtcctacatcctgtatgacctgcaggaagccacctggtatgagctgcagatgcgggtgtgcaacagtgcgggctgcgcggagaagcaggccaacttcgctacgctgaactacgatggcagtacaattcctccactcattaagtcagttgtccaaaacgaagaagggctgacgaccaacgaggggctcaagatgctggtgaccatctcctgtatcctggtgggggtcttgctgctgtttgtgctcctgctggttgtgcggaggaggcggcgggagcagaggctaaagaggctgcgagatgcaaagagtttagctgaaatgctcatgagtaagaatacccggacttcagatacgttaagcaagcaacagcagaccctgcgaatgcacatcgacatacccagggctcagcttttgattgaagagagagacacgatggagaccattgatgatcgctccacggttctgttgacggatgctgactttggagaggcagctaagcagaagtccctgacggtcactcacacggtccattaccaatcggtgtctcaggccactgggcccttagtggatgtttcagacgctcggccgggaacgaatcccaccaccaggaggaatgccaaggctgggcccacagcgagaaaccgctatgccagccagtggaccctcaaccgaccccaccccaccatctcagcacacaccctcaccacagactggaggctgccaacacccagggctgcaggatcagtagacaaagagagcgacagttacagcgtcagcccctcgcaagacacagatcgagcaagaagcagcatggtctccacagaaagtgcctcctccacttacgaagaactggccagggcctacgaacacgccaagatggaagagcaactgaggcacgccaagttcaccatcacggagtgcttcatatcagacacgtcatcggagcagttgacggcagggacaaatgagtacacggacagtctgacctccagcaccccttccgaatcgggaatctgcaggttcactgcatctccccccaaacctcaggatggaggaagagtaatgaatatggcagttccaaaggcacatcggccaggtgacctcatacatttgcctccataccttagaatggactttttgttaaaccgaggtggtccaggcaccagcagggacctgagcttaggacaagcatgcttggaacctcagaaaagccggaccctgaagcgccccacggtcctggagcccatcccgatggaagccgcctcctccgcctcctccacgagagaaggacagtcgtggcagccgggggccgtggccacattacctcagcgggagggagcagagctgggacaggcagctaaaatgagcagctcccaagaatcactgctcgactcccggggccatttgaaaggaaacaatccttacgcaaaatcttacaccctggtataacagacagcatgactggacagcggttgtaaatacaattcaaacaattcaatcaaagctaccttttttttacggaattccaatatttataattaaagaaaattgccaaaatatattaaaaaaaaaaaagagaaaatactgaaaccacagacagtgcaaagactctcctgctttttttctgtctgagtgtgagctccatccgcctgggcatctgattttttgggaaagaagtccagttttatgatcttcacaggctattgcatttttactgattttctacaaaagtgcatgggggggattaattaaaccttctgactggaagttctatcacacaagaggcaagaaagaaaacagggtgggtgggaaatcagcctatttgtgaatttaaaaggaacaccgatttgcgggcaggggaaaacttcagtcacgtttgcacacctttctttcccattagaaaccgggttctcaatttggtcttcttttgttgttaattaggatgagtgccgtcagtgaaggggtggggggaatcaatttggttttctctcttgtttcttttttaatttaatgagacactctttgcattttgtctaagcgaaataaaaaagaaaaggttgtctgcctttattt

SEQ ID NO: 307715 - DNA, 5969 bp, Homo sapiens
agggaaggttggcagagggatccatgtgactgaggccggagcacggcaaagatgagcctgcccgcccgcctgctgcctggatgcggagggtgagggctggcgcacgggaggccgctggctgcgcattctgggcgccgagtgcccgggatgagctcacgcccgcgtctgcggctctctccacctgccgacctgccgggggcccactgagctgacggcgcacctgggctccggccgcagcgtggggcgcggcgcccgggagcaggtgtgcaggagcgcagcgcgcggcgagcgcagccctcgctccggagcccggccgcgccgcgtgcccgggcggctaggcagcggcggcggcggcggcgggcggcgggcgggcggcggcccccgggcaggtgccgagcggcgagcggagccgggccgggcggagcgcggggggcgaggccggcgcgtcgctcgcgggaggccggggagcggcaggggcatgtggatactggctctctccttgttccagagcttcgcgaatgttttcagtgaagacctacactccagcctctactttgtcaatgcatctctgcaagaggtagtgtttgccagcaccacggggactctggtgccctgccccgcagcaggcatccctcctgtgactctcagatggtacctagccacgggcgaggagatctacgatgtccccgggatccgccacgtccaccccaacggcactctccaaattttccccttccctccttcaagcttcagtaccttaatccatgataatacttattattgcacagctgaaaatccttcagggaaaattagaagtcaggatgtccacatcaaggctgttttacgggagccctatacagtccgtgtggaggaccagaaaaccatgagaggcaatgttgcggtcttcaagtgcattatcccctcctcggtggaggcgtacatcactgtcgtctcatgggagaaagacactgtttcacttgtctcaggatctagatttctcatcacatccacgggagccttgtatattaaagatgtacagaatgaagatggattgtataactaccgctgcatcacgcggcatcgatacaccggagagacgaggcagagcaacagcgccagactttttgtatcagacccagcgaactcagccccatccatactggatgggtttgaccatcgcaaagccatggctgggcagcgtgtggagctgccttgcaaagcgctcgggcaccctgagccagattaccgctggctgaaggacaacatgcccctggaactttcagggaggttccagaagaccgtgacggggctgctcattgagaacattcgcccctcggactcaggcagctatgtttgtgaagtgtccaacagatacggaactgctaaggtgataggccgcctgtacgtgaaacagccactgaaagccaccatcagtcccaggaaggttaaaagcagcgtgggtagccaagtttccttgtcctgcagcgtgacaggaactgaggaccaggaactctcctggtaccgcaatggtgaaatcctcaaccctggaaaaaatgtgaggatcacagggatcaaccacgaaaaccttataatggatcacatggtcaaaagtgacgggggcgcataccagtgctttgtgcgcaaggacaagctgtccgctcaagactatgtgcaggtggtccttgaagatggaactcccaaaattatttctgcctttagtgaaaaggtggtgagtccagcagagccggtttcccttatgtgcaacgtgaagggaacacctttgcccacgatcacgtggaccctggacgatgacccgattctcaagggtggcagtcaccgcatcagccagatgatcacgtcggaggggaacgtggtcagctacctgaacatctccagctcccaggtccgggacgggggagtctaccgctgcactgccaacaactcggcgggagtcgtcctgtaccaggctcgaataaacgtaagagggcctgcaagcattcgaccaatgaaaaacatcacagcaatagcaggacgggacacatacattcactgtcgtgtgattggctatccgtattactccattaaatggtacaagaactctaacctgcttcctttcaaccaccgccaagtggcatttgagaacaatggaactcttaaactttcagatgtgcaaaaggaagtggacgagggggagtacacgtgcaacgtgttggttcaaccacaactctccaccagccagagcgtccacgtgaccgtgaaagttccgcctttcatacaaccctttgagtttccaagattctccattgggcagcgggtcttcatcccctgtgttgtggtctcaggggacttacccatcacgatcacctggcagaaggatggccggccaatccctgggagccttggggtgaccattgacaatattgacttcacgagctccttgaggatttccaatctctcgctcatgcacaatgggaattacacctgcatagcccggaatgaggccgccgctgtggagcaccaaagccagttgattgtcagagttcctcccaagtttgtggttcagccacgggaccaggacgggatttatggcaaagcagtcatcctcaattgttctgctgagggttaccctgtacctaccatcgtgtggaaattctctaaaggtgctggggttccccagttccagccaattgccctaaatggccgaatccaagttctcagcaatgggtcgttgctgatcaagcatgtcgtggaggaagacagtggctactacctctgcaaggtcagcaacgatgtgggcgcagacgtcagcaagtccatgtacctcacggttaaaattcctgcgatgataacatcctatccaaatactaccctggccacgcaggggcagaaaaaggagatgagctgcacggcgcatggtgagaagcccattatagtccgctgggagaaggaggaccgaatcattaaccctgagatggcccgttatcttgtgtccaccaaggaggtgggagaagaggtgatttctactctgcagattttgccaactgtgagagaagattctggtttcttttcctgccatgctattaattcttatggggaggaccgtggaataattcagctcacagtgcaagagcccccagaccctcccgaaattgagatcaaagatgtcaaagcacgcacaattacgctcaggtggaccatggggtttgatggaaacagtcccatcacaggctacgatattgaatgcaaaaataaatcagactcctgggattctgctcagagaaccaaagatgtttcccctcagctgaactcggccaccatcattgatatccacccttcctccacctacagcatccgcatgtacgccaagaaccggattggcaagagcgagcccagcaacgagctcaccatcacggcggacgaggcagctcctgatggtccacctcaggaagttcacctggagcctatatcatctcagagcatcagggtcacatggaaggctcccaagaaacatttgcaaaatgggattatccgtggctaccaaataggttaccgagagtacagcactgggggtaacttccaattcaacattatcagtgtcgacaccagcggggacagtgaggtttacaccctggacaacctgaataagttcactcagtacggcctggtggtgcaggcctgtaaccgggccggcacggggccttcttctcaggaaatcatcaccaccactctcgaggatgtgcccagttacccccccgaaaatgtccaagccatagcaacatcaccagaaagcatatcaatatcctggtccacactttccaaggaagccttgaatggaattctccaggggttcagagtcatttactgggccaacctcatggacggagagctgggtgagattaaaaacatcaccaccacacagccttcactggagctggacgggctggaaaagtacaccaactacagcatccaggtgctggccttcacccgcgcaggagacggggtcaggagtgagcagatcttcacccggaccaaagaggatgttccaggtcctcccgcgggtgtgaaggcagcggcggcctcagcctccatggtctttgtgtcctggcttccccctctcaagctgaacggcatcatccgaaagtacactgtattctgctcccacccctatcccacagtgatcagcgagtttgaggcctctcccgactcgttttcctacagaattcccaacctgagtaggaatcgtcagtacagcgtctgggtggtggctgttacttcagccggaagaggcaacagcagtgaaatcatcacagtcgagccactagcaaaagctcctgcacgaatcctgaccttcagtgggacagtgactactccatggatgaaagacattgtcttgccttgtaaggctgttggggacccttctcctgcagtcaaatggatgaaagacagtaacgggacacccagtctagtaacgattgatgggcggaggagcatctttagcaacggaagcttcattattcgcacggtgaaagcagaagactccggctattacagctgcattgccaataacaactggggatctgatgaaattattttaaacttacaagtacaagttccaccagatcagcctcggcttacagtctccaagaccacgtcttcctccatcaccctttcttggctccctggagacaacgggggcagctctatcagaggatacatactgcagtactccgaggacaatagtgagcagtgggggagttttccaatcagccccagcgaacgttcctatcgcttggaaaatctcaaatgtgggacttggtataagttcacactgacagcccaaaatggagtgggcccagggcgcataagtgaaatcatagaagcaaagaccttaggaaaagagccccagttctcaaaggagcaggagctgtttgccagcatcaacaccacacgcgtgaggctgaacctcattggctggaatgatggcggctgccccatcacctccttcacactagagtacaggccctttgggaccacagtttggaccacagctcagaggacctctctctccaagtcctacatcctgtatgacctgcaggaagccacctggtatgagctgcagatgcgggtgtgcaacagtgcgggctgcgcggagaagcaggccaacttcgctacgctgaactacgatggcagtacaattcctccactcattaagtcagttgtccaaaacgaagaagggctgacgaccaacgaggggctcaagatgctggtgaccatctcctgtatcctggtgggggtcttgctgctgtttgtgctcctgctggttgtgcggaggaggcggcgggagcagaggctaaagaggctgcgagatgcaaagagtttagctgaaatgctcatgagtaagaatacccggacttcagatacgttaagcaagcaacagcagaccctgcgaatgcacatcgacatacccagggctcagcttttgattgaagagagagacacgatggagaccattgatgatcgctccacggttctgttgacggatgctgactttggagaggcagctaagcagaagtccctgacggtcactcacacggtccattaccaatcggtgtctcaggccactgggcccttagtggatgtttcagacgctcggccgggaacgaatcccaccaccaggaggaatgccaaggctgggcccacagcgagaaaccgctatgccagccagtggaccctcaaccgaccccaccccaccatctcagcacacaccctcaccacagactggaggctgccaacacccagggctgcaggatcagtagacaaagagagcgacagttacagcgtcagcccctcgcaagacacagaatgaagcgtaatgggacgtggatcgtgatcctcgtgtgtccgtcaatctgatagcagtgaccttgccagaagtttttcattagcattgcgtctccagggaagaacgg

SEQ ID NO: 307716 - DNA, 3630 bp, Homo sapiens
agcggcggcaggtctgaacgcttcggtaggataagtgcggtgggagggggctctgcggttttggggagcccagggcgggaacccggacccggctggaagtccggagcctggccgcagccccgcccctccgctctttcttggtgaccttaagccagtggctgcctttttctgagcccgggcggggccgaaggcggcccgtaggccctcgggactcccagcactgcagagggtgtgaggtctgacatccaagacacgttgtttcgtatttctgaaggaagaactcaagctccgggaagtgatggctggggatggggcgggcaacttggggaccgagtgtacgatccacgcctaaggttgagggcggccgagctagccaggcagccgtgaccccagtgcttttcagacgtttcttagcttccagagcccaacacatacagctgatacacgcagaccagatctggtcaggtcctcggaagctgagtccagagcgatgctgctgaagacagtgctcttgctgggacatgtggcccaggtgctgatgctggacaatgggctcctgcagacaccacccatgggctggctggcctgggaacgcttccgctgcaacattaactgtgatgaggacccaaagaactgcataagtgaacagctcttcatggagatggctgaccggatggcacaggatggatggcgggacatgggctacacatacctcaacattgatgactgctggatcggtggtcgcgatgccagtggccgcctgatgccagatcccaagcgcttccctcatggcattcctttcctggctgactacgttcactccctgggcctgaagttgggtatctacgcggacatgggcaacttcacctgcatgggttacccaggcaccacactggacaaggtggtccaggatgctcagaccttcgccgagtggaaggtagacatgctcaagctggatggctgcttctccacccccgaggagcgggcccaggggtaccccaagatggctgctgccctgaatgccacaggccgccccatcgccttctcctgcagctggccagcctatgaaggcggcctccccccaagggtgaactacagtctgctggcggacatctgcaacctctggcgtaactatgatgacatccaggactcctggtggagcgtgctctccatcctgaattggttcgtggagcaccaggacatactgcagccagtggccggccctgggcactggaatgaccctgacatgctgctcattgggaactttggtctcagcttagagcaatcccgggcccagatggccctgtggacggtgctggcagcccccctcttgatgtccacagacctgcgtaccatctccgcccagaacatggacattctgcagaatccactcatgatcaaaatcaaccaggatcccttaggcatccagggacgcaggattcacaaggaaaaatctctcatcgaagtgtacatgcggcctctgtccaacaaggctagcgccttagtcttcttcagctgcaggaccgatatgccttatcgctaccactcctcccttggccagctgaacttcaccgggtctgtgatatatgaggcccaggacgtctactcaggtgacatcatcagtggcctccgagatgaaaccaacttcacagtgatcatcaacccttcaggggtagtgatgtggtacctgtatcccatcaagaacctggagatgtcccagcagtgaggagctgggacatgtgacaggctgtggtggcaccactgagcctagaccatggagccttggcatgcccagggcaagtggggaggttctctgctccccaggcctgctcggtgactgaccccatcatacccaaagtgcaatctcacggccaggttctatgccctgtccaagcgtaaaccctcttggaaacttcttttggggcaattttcctgtggccttcctggcctctacttccatgtgcgcagccccacagacgttgctgagcaactcgccagcctcctgagctccatgcccatcaggactctagcctctgaccttgctgttgactctgaaatcaggatttggaagttttcgaattaggagtagagagatctgacctcttgccaggaatgcccatggatcatgtgattggcttttctacccatagagggccttgcagcctgataccacctgggagtgagggtcacaaaggagaccttggctccctcaggtcaccaataaacctgttctttaatcaagtagttgtaatatggacctggggtacctttagttagggactctggtggcactacacggggtgctggattcaaatctcacctctatggatgatgtctggcatcgtctggcccctccttttccaaagtgaccagaagattgtacttcctagagatgccagacttgcctcacacccaggagctgcccctgctgtgcctggtatgctggcagtggtgatggtgacaacacaatgaggccaagtagcaatgctcccaggtcctgcagcttgtgctctgcccagcagtgcccctggcccagcacctcagcctgctcttctctctggtggctccaccccaacccctacttcttttcctttatttctctcccaacctggctgcaaaggaggttcatattccccagatgtgtccacaaacctgtccaggagttgtgtcttaaaattgatttcctgtccctcttcctaaggacaggggtaacagtcaaagtgaaggaatgatgggttcttgcctgtcttgctttggtccgtatttcccaagccctcctcttttagccaaggctacagggcacttgtcttccctggtggctctcccctttggagagagctagtggcagagcaacctagctaggtcctccttgggctttgaatgcaggagcacccagtgccccaggccttgcactgtgctgcccaaggagtattttctgggtggatctcccatactcctcagggttctgaggtccttgtatttagggtatggtgtaaaaacttacatatgcacattttgttacatcatttaagatgattgaagctttactggttaagtacagggtcaccagagaaagttcctttccccagttgatgtcttgaggctgttgagaaacttaggacagaagcctacctcatcccaggcctgcccctccgtgcatagctctgcctttgggtcttgttcatagtgctgttcaggcaaaatggaatagtctcaggtgggaacaccttctcttgctagctccaggaaggctttgtgggaaatgagttgagaccatggacttgggagttgggggccagagttgagcctggacttgaccaattaattcccttacctttcagcccaagatagctacatgtctttacttgctgtataagttttccttttgtcctgggggtgcctgattgatcctatctcttcacccttcattctttcaacaaacatgccatctatctcccaggacatttattcccttctattcaaggccagttaggaatgcaattattttttttttcagttaaatacagacttgtttggacgcaaggtaccctttctctttttaaaaactttttatcatgaaaactttcaaatacaaaaataaaatggtagagtgaacctccatgtacccag

SEQ ID NO: 307717 - DNA, 2240 bp, Homo sapiens
agcggcggcaggtctgaacgcttcggtaggataagtgcggtgggagggggctctgcggttttggggagcccagggcgggaacccggacccggctggaagtccggagcctggccgcagccccgcccctccgctctttcttggtgaccttaagccagtggctgcctttttctgagcccgggcggggccgaaggcggcccgtaggccctcgggactcccagcactgcagagggtgtgaggtctgacatccaagacacgttgtttcgtatttctgaaggaagaactcaagctccgggaagtgatggctggggatggggcgggcaacttggggaccgagtgtacgatccacgcctaaggttgagggcggccgagctagccaggcagccgtgaccccagtgcttttcagacgtttcttagcttccagagcccaacacatacagctgatacacgcagaccagatctggtcaggtcctcggaagctgagtccagagcgatgctgctgaagacagtgctcttgctgggacatgtggcccaggtgctgatgctggacaatgggctcctgcagacaccacccatgggctggctggcctgggaacgcttccgctgcaacattaactgtgatgaggacccaaagaactgcataagtgaacagctcttcatggagatggctgaccggatggcacaggatggatggcgggacatgggctacacatacctcaacattgatgactgctggatcggtggtcgcgatgccagtggccgcctgatgccagatcccaagcgcttccctcatggcattcctttcctggctgactacgttcactccctgggcctgaagttgggtatctacgcggacatgggcaacttcacctgcatgggttacccaggcaccacactggacaaggtggtccaggatgctcagaccttcgccgagtggaaggtagacatgctcaagctggatggctgcttctccacccccgaggagcgggcccaggggtaccccaagatggctgctgccctgaatgccacaggccgccccatcgccttctcctgcagctggccagcctatgaaggcggcctccccccaagggtgaactacagtctgctggcggacatctgcaacctctggcgtaactatgatgacatccaggactcctggtggagcgtgctctccatcctgaattggttcgtggagcaccaggacatactgcagccagtggccggccctgggcactggaatgaccctgacatgctgctcattgggaactttggtctcagcttagagcaatcccgggcccagatggccctgtggacggtgctggcagcccccctcttgatgtccacagacctgcgtaccatctccgcccagaacatggacattctgcagaatccactcatgatcaaaatcaaccaggatcccttaggcatccagggacgcaggattcacaaggaaaaatctctcatcgaagtgtacatgcggcctctgtccaacaaggctagcgccttagtcttcttcagctgcaggaccgatatgccttatcgctaccactcctcccttggccagctgaacttcaccgggtctgtgatatatgaggcccaggacgtctactcaggtgacatcatcagtggcctccgagatgaaaccaacttcacagtgatcatcaacccttcaggggtagtgatgtggtacctgtatcccatcaagaacctggagatgtcccagcagtgaggagctgggacatgtgacaggctgtggtggcaccactgagcctagaccatggagccttggcatgcccagggcaagtggggaggttctctgctccccaggcctgctcggtgactgaccccatcatacccaaagtgcaatctcacggccaggttctatgccctgtccaagcgtaaaccctcttggaaacttcttttggggcaattttcctgtggccttcctggcctctacttccatgtgcgcagccccacagacgttgctgagcaactcgccagcctcctgagctccatgcccatcaggactctagcctctgaccttgctgttgactctgaaatcaggatttggaagttttcgaattaggagtagagagatctgacctcttgccaggaatgcccatggatcatgtgattggcttttctacccatagagggccttgcagcctgataccacctgggagtgagggtcacaaaggagaccttggctccctcaggtcaccaataaacctgttctttaatca

SEQ ID NO: 307718 - DNA, 4095 bp, Homo sapiens
agcggcggcaggtctgaacgcttcggtaggataagtgcggtgggagggggctctgcggttttggggagcccagggcgggaacccggacccggctggaagtccggagcctggccgcagccccgcccctccgctctttcttggtgaccttaagccagtggctgcctttttctgagcccgggcggggccgaaggcggcccgtaggccctcgggactcccagcactgcagagggtgtgaggtctgacatccaagacacgttgtttcgtatttctgaaggaagaactcaagctccgggaagtgatggctggggatggggcgggcaacttggggaccgagtgtacgatccacgcctaaggttgagggcggccgagctagccaggcagccgtgaccccagtgcttttcagacgtttcttagcttccagagcccaacacatacagctgatacacgcagaccagatctggtcaggtcctcggaagctgagtccagagcgatgctgctgaagacagtgctcttgctgggacatgtggcccaggtgctgatgctggacaatgggctcctgcagacaccacccatgggctggctggcctgggaacgcttccgctgcaacattaactgtgatgaggacccaaagaactgcataagtgaacagctcttcatggagatggctgaccggatggcacaggatggatggcgggacatgggctacacatacctcaacattgatgactgctggatcggtggtcgcgatgccagtggccgcctgatgccagatcccaagcgcttccctcatggcattcctttcctggctgactacgttcactccctgggcctgaagttgggtatctacgcggacatgggcaacttcacctgcatgggttacccaggcaccacactggacaaggtggtccaggatgctcagaccttcgccgagtggaaggtagacatgctcaagctggatggctgcttctccacccccgaggagcgggcccaggggtaccccaagatggctgctgccctgaatgccacaggccgccccatcgccttctcctgcagctggccagcctatgaaggcggcctccccccaagggtgaactacagtctgctggcggacatctgcaacctctggcgtaactatgatgacatccaggactcctggtggagcgtgctctccatcctgaattggttcgtggagcaccaggacatactgcagccagtggccggccctgggcactggaatgaccctgacatgctgctcattgggaactttggtctcagcttagagcaatcccgggcccagatggccctgtggacggtgctggcagcccccctcttgatgtccacagacctgcgtaccatctccgcccagaacatggacattctgcagaatccactcatgatcaaaatcaaccaggatcccttaggcatccagggacgcaggattcacaaggaaaaatctctcatcgaagtgtacatgcggcctctgtccaacaaggctagcgccttagtcttcttcagctgcaggaccgatatgccttatcgctaccactcctcccttggccagctgaacttcaccgggtctgtgatatatgaggcccaggacgtctactcaggtgacatcatcagtggcctccgagatgaaaccaacttcacagtgatcatcaacccttcaggggtagtgatgtggtacctgtatcccatcaagaacctggagatgtcccagcagtgaggagctgggacatgtgacaggctgtggtggcaccactgagcctagaccatggagccttggcatgcccagggcaagtggggaggttctctgctccccaggcctgctcggtgactgaccccatcatacccaaagtgcaatctcacggccaggttctatgccctgtccaagcgtaaaccctcttggaaacttcttttggggcaattttcctgtggccttcctggcctctacttccatgtgcgcagccccacagacgttgctgagcaactcgccagcctcctgagctccatgcccatcaggactctagcctctgaccttgctgttgactctgaaatcaggatttggaagttttcgaattaggagtagagagatctgacctcttgccaggaatgcccatggatcatgtgattggcttttctacccatagagggccttgcagcctgataccacctgggagtgagggtcacaaaggagaccttggctccctcaggtcaccaataaacctgttctttaatcaagtagttgtaatatggacctggggtacctttagttagggactctggtggcactacacggggtgctggattcaaatctcacctctatggatgatgtctggcatcgtctggcccctccttttccaaagtgaccagaagattgtacttcctagagatgccagacttgcctcacacccaggagctgcccctgctgtgcctggtatgctggcagtggtgatggtgacaacacaatgaggccaagtagcaatgctcccaggtcctgcagcttgtgctctgcccagcagtgcccctggcccagcacctcagcctgctcttctctctggtggctccaccccaacccctacttcttttcctttatttctctcccaacctggctgcaaaggaggttcatattccccagatgtgtccacaaacctgtccaggagttgtgtcttaaaattgatttcctgtccctcttcctaaggacaggggtaacagtcaaagtgaaggaatgatgggttcttgcctgtcttgctttggtccgtatttcccaagccctcctcttttagccaaggctacagggcacttgtcttccctggtggctctcccctttggagagagctagtggcagagcaacctagctaggtcctccttgggctttgaatgcaggagcacccagtgccccaggccttgcactgtgctgcccaaggagtattttctgggtggatctcccatactcctcagggttctgaggtccttgtatttagggtatggtgtaaaaacttacatatgcacattttgttacatcatttaagatgattgaagctttactggttaagtacagggtcaccagagaaagttcctttccccagttgatgtcttgaggctgttgagaaacttaggacagaagcctacctcatcccaggcctgcccctccgtgcatagctctgcctttgggtcttgttcatagtgctgttcaggcaaaatggaatagtctcaggtgggaacaccttctcttgctagctccaggaaggctttgtgggaaatgagttgagaccatggacttgggagttgggggccagagttgagcctggacttgaccaattaattcccttacctttcagcccaagatagctacatgtctttacttgctgtataagttttccttttgtcctgggggtgcctgattgatcctatctcttcacccttcattctttcaacaaacatgccatctatctcccaggacatttattcccttctattcaaggccagttaggaatgcaattattttttttttcagttaaatacagacttgtttggacgcaaggtaccctttctctttttaaaaactttttatcatgaaaactttcaaatacaaaaataaaatggtagagtgaacctccatgtacccagcatccagctccagtaaccatcaacgtgtaccattatttcatctctcttcctgcacatgctcttctgatgtgtgagctagagtatctgaaaggaaatttcagaaaaccctaaaaaccactatgtctctaacagataagggctttaaaaatacatatatgagccgggcgcggtgactcatgcctgtaatcccagcactttgggaggctgaggtaggcggatcacaaggtcaggagattgagaccatcctggctaacacggtgaaaccccatctctattaaaaatacaaaaaattagccgggcatggtggtgggcgcctgtagtcccagccactcgggaggctgaggcaggagaacagcgtgatcctgggaggcggaggttgcagtgagccgagatggcaccaccatactccagcctgggtgacagagccagactccatctcaaaaaaaaaaaaaaaaaaaaaaaaaa

SEQ ID NO: 307719 - DNA, 3872 bp, Homo sapiens
agcggcggcaggtctgaacgcttcggtaggataagtgcggtgggagggggctctgcggttttggggagcccagggcgggaacccggacccggctggaagtccggagcctggccgcagccccgcccctccgctctttcttggtgaccttaagccagtggctgcctttttctgagcccgggcggggccgaaggcggcccgtaggccctcgggactcccagcactgcagagggtgtgaggtctgacatccaagacacgttgtttcgtatttctgaaggaagaactcaagctccgggaagtgatggctggggatggggcgggcaacttggggaccgagtgtacgatccacgcctaaggttgagggcggccgagctagccaggcagccgtgaccccagtgcttttcagacgtttcttagcttccagagcccaacacatacagctgatacacgcagaccagatctggtcaggtcctcggaagctgagtccagagcgatgctgctgaagacagtgctcttgctgggacatgtggcccaggtgctgatgctggacaatgggctcctgcagacaccacccatgggctggctggcctgggaacgcttccgctgcaacattaactgtgatgaggacccaaagaactgcataagtgaacagctcttcatggagatggctgaccggatggcacaggatggatggcgggacatgggctacacatacctcaacattgatgactgctggatcggtggtcgcgatgccagtggccgcctgatgccagatcccaagcgcttccctcatggcattcctttcctggctgactacgttcactccctgggcctgaagttgggtatctacgcggacatgggcaacttcacctgcatgggttacccaggcaccacactggacaaggtggtccaggatgctcagaccttcgccgagtggaaggtagacatgctcaagctggatggctgcttctccacccccgaggagcgggcccaggggtaccccaagatggctgctgccctgaatgccacaggccgccccatcgccttctcctgcagctggccagcctatgaaggcggcctccccccaagggtgaactacagtctgctggcggacatctgcaacctctggcgtaactatgatgacatccaggactcctggtggagcgtgctctccatcctgaattggttcgtggagcaccaggacatactgcagccagtggccggccctgggcactggaatgaccctgacatgctgctcattgggaactttggtctcagcttagagcaatcccgggcccagatggccctgtggacggtgctggcagcccccctcttgatgtccacagacctgcgtaccatctccgcccagaacatggacattctgcagaatccactcatgatcaaaatcaaccaggatcccttaggcatccagggacgcaggattcacaaggaaaaatctctcatcgaagtgtacatgcggcctctgtccaacaaggctagcgccttagtcttcttcagctgcaggaccgatatgccttatcgctaccactcctcccttggccagctgaacttcaccgggtctgtgatatatgaggcccaggacgtctactcaggtgacatcatcagtggcctccgagatgaaaccaacttcacagtgatcatcaacccttcaggggtagtgatgtggtacctgtatcccatcaagaacctggagatgtcccagcagtgaggagctgggacatgtgacaggctgtggtggcaccactgagcctagaccatggagccttggcatgcccagggcaagtggggaggttctctgctccccaggcctgctcggtgactgaccccatcatacccaaagtgcaatctcacggccaggttctatgccctgtccaagcgtaaaccctcttggaaacttcttttggggcaattttcctgtggccttcctggcctctacttccatgtgcgcagccccacagacgttgctgagcaactcgccagcctcctgagctccatgcccatcaggactctagcctctgaccttgctgttgactctgaaatcaggatttggaagttttcgaattaggagtagagagatctgacctcttgccaggaatgcccatggatcatgtgattggcttttctacccatagagggccttgcagcctgataccacctgggagtgagggtcacaaaggagaccttggctccctcaggtcaccaataaacctgttctttaatcaagtagttgtaatatggacctggggtacctttagttagggactctggtggcactacacggggtgctggattcaaatctcacctctatggatgatgtctggcatcgtctggcccctccttttccaaagtgaccagaagattgtacttcctagagatgccagacttgcctcacacccaggagctgcccctgctgtgcctggtatgctggcagtggtgatggtgacaacacaatgaggccaagtagcaatgctcccaggtcctgcagcttgtgctctgcccagcagtgcccctggcccagcacctcagcctgctcttctctctggtggctccaccccaacccctacttcttttcctttatttctctcccaacctggctgcaaaggaggttcatattccccagatgtgtccacaaacctgtccaggagttgtgtcttaaaattgatttcctgtccctcttcctaaggacaggggtaacagtcaaagtgaaggaatgatgggttcttgcctgtcttgctttggtccgtatttcccaagccctcctcttttagccaaggctacagggcacttgtcttccctggtggctctcccctttggagagagctagtggcagagcaacctagctaggtcctccttgggctttgaatgcaggagcacccagtgccccaggccttgcactgtgctgcccaaggagtattttctgggtggatctcccatactcctcagggttctgaggtccttgtatttagggtatggtgtaaaaacttacatatgcacattttgttacatcatttaagatgattgaagctttactggttaagtacagggtcaccagagaaagttcctttccccagttgatgtcttgaggctgttgagaaacttaggacagaagcctacctcatcccaggcctgcccctccgtgcatagctctgcctttgggtcttgttcatagtgctgttcaggcaaaatggaatagtctcaggtgggaacaccttctcttgctagctccaggaaggctttgtgggaaatgagttgagaccatggacttgggagttgggggccagagttgagcctggacttgaccaattaattcccttacctttcagcccaagatagctacatgtctttacttgctgtataagttttccttttgtcctgggggtgcctgattgatcctatctcttcacccttcattctttcaacaaacatgccatctatctcccaggacatttattcccttctattcaaggccagttaggaatgcaattattttttttttcagttaaatacagacttgtttggacgcaaggtaccctttctctttttaaaaactttttatcatgaaaactttcaaatacaaaaataaaatggtagagtgaacctccatgtacccagaaaaaaaaaaaaaaaaaaaaaaaaaaaacaaaaaaaaaaaaaaaaaaccaaacaaaagacaagaaagaaccacaagaaaaaaaaaagagtcgggcgcccccgccagcagcgcagagaaagaggctccaacacacaacttggtggaggcgccggaccaccacactagtaaaaaacagcacgggcacagagcgtcacgcgagacgacccgggagaaagcagggcggggtccacccagaaacgcg

SEQ ID NO: 307720 - DNA, 2506 bp, Homo sapiens
agcggcggcaggtctgaacgcttcggtaggataagtgcggtgggagggggctctgcggttttggggagcccagggcgggaacccggacccggctggaagtccggagcctggccgcagccccgcccctccgctctttcttggtgaccttaagccagtggctgcctttttctgagcccgggcggggccgaaggcggcccgtaggccctcgggactcccagcactgcagagggtgtgaggtctgacatccaagacacgttgtttcgtatttctgaaggaagaactcaagctccgggaagtgatggctggggatggggcgggcaacttggggaccgagtgtacgatccacgcctaaggttgagggcggccgagctagccaggcagccgtgaccccagtgcttttcagacgtttcttagcttccagagcccaacacatacagctgatacacgcagaccagatctggtcaggtcctcggaagctgagtccagagcgatgctgctgaagacagtgctcttgctgggacatgtggcccaggtgctgatgctggacaatgggctcctgcagacaccacccatgggctggctggcctgggaacgcttccgctgcaacattaactgtgatgaggacccaaagaactgcataagtgaacagctcttcatggagatggctgaccggatggcacaggatggatggcgggacatgggctacacatacctcaacattgatgactgctggatcggtggtcgcgatgccagtggccgcctgatgccagatcccaagcgcttccctcatggcattcctttcctggctgactacccttcctggcctctacttccatgtgcgcagccccacagacgttgctgagcaactcgccagcctcctgagctccatgcccatcaggactctagcctctgaccttgctgttgactctgaaatcaggatttggaagttttcgaattaggagtagagagatctgacctcttgccaggaatgcccatggatcatgtgattggcttttctacccatagagggccttgcagcctgataccacctgggagtgagggtcacaaaggagaccttggctccctcaggtcaccaataaacctgttctttaatcaagtagttgtaatatggacctggggtacctttagttagggactctggtggcactacacggggtgctggattcaaatctcacctctatggatgatgtctggcatcgtctggcccctccttttccaaagtgaccagaagattgtacttcctagagatgccagacttgcctcacacccaggagctgcccctgctgtgcctggtatgctggcagtggtgatggtgacaacacaatgaggccaagtagcaatgctcccaggtcctgcagcttgtgctctgcccagcagtgcccctggcccagcacctcagcctgctcttctctctggtggctccaccccaacccctacttcttttcctttatttctctcccaacctggctgcaaaggaggttcatattccccagatgtgtccacaaacctgtccaggagttgtgtcttaaaattgatttcctgtccctcttcctaaggacaggggtaacagtcaaagtgaaggaatgatgggttcttgcctgtcttgctttggtccgtatttcccaagccctcctcttttagccaaggctacagggcacttgtcttccctggtggctctcccctttggagagagctagtggcagagcaacctagctaggtcctccttgggctttgaatgcaggagcacccagtgccccaggccttgcactgtgctgcccaaggagtattttctgggtggatctcccatactcctcagggttctgaggtccttgtatttagggtatggtgtaaaaacttacatatgcacattttgttacatcatttaagatgattgaagctttactggttaagtacagggtcaccagagaaagttcctttccccagttgatgtcttgaggctgttgagaaacttaggacagaagcctacctcatcccaggcctgcccctccgtgcatagctctgcctttgggtcttgttcatagtgctgttcaggcaaaatggaatagtctcaggtgggaacaccttctcttgctagctccaggaaggctttgtgggaaatgagttgagaccatggacttgggagttgggggccagagttgagcctggacttgaccaattaattcccttacctttcagcccaagatagctacatgtctttacttgctgtataagttttccttttgtcctgggggtgcctgattgatcctatctcttcacccttcattctttcaacaaacatgccatctatctcccaggacatttattcccttctattcaaggccagttaggaatgcaattattttttttttcagttaaatacagacttgtttggacgcaaggtaccctttctctttttaaaaactttttatcatgaaaactttcaaatacaaaaataaaatggtagagtgaacctccatgtacccag

SEQ ID NO: 307721 - DNA, 2334 bp, Homo sapiens
agcggcggcaggtctgaacgcttcggtaggataagtgcggtgggagggggctctgcggttttggggagcccagggcgggaacccggacccggctggaagtccggagcctggccgcagccccgcccctccgctctttcttggtgaccttaagccagtggctgcctttttctgagcccgggcggggccgaaggcggcccgtaggccctcgggactcccagcactgcagagggtgtgaggtctgacatccaagacacgttgtttcgtatttctgaaggaagaactcaagctccgggaagtgatggctggggatggggcgggcaacttggggaccgagtgtacgatccacgcctaaggttgagggcggccgagctagccaggcagccgtgaccccagtgcttttcagacgtttcttagcttccagagcccaacacatacagctgatacacgcagaccagatctggtcaggtcctcggaagctgagtccagagcgatgctgctgaagacagtgctcttgctgggacatgtggcccaggtgctgatgctggacaatgggctcctgcagacaccacccatgggctggctggcctgggaacgcttccgctgcaacattaactgtgatgaggacccaaagaactgcataagccttcctggcctctacttccatgtgcgcagccccacagacgttgctgagcaactcgccagcctcctgagctccatgcccatcaggactctagcctctgaccttgctgttgactctgaaatcaggatttggaagttttcgaattaggagtagagagatctgacctcttgccaggaatgcccatggatcatgtgattggcttttctacccatagagggccttgcagcctgataccacctgggagtgagggtcacaaaggagaccttggctccctcaggtcaccaataaacctgttctttaatcaagtagttgtaatatggacctggggtacctttagttagggactctggtggcactacacggggtgctggattcaaatctcacctctatggatgatgtctggcatcgtctggcccctccttttccaaagtgaccagaagattgtacttcctagagatgccagacttgcctcacacccaggagctgcccctgctgtgcctggtatgctggcagtggtgatggtgacaacacaatgaggccaagtagcaatgctcccaggtcctgcagcttgtgctctgcccagcagtgcccctggcccagcacctcagcctgctcttctctctggtggctccaccccaacccctacttcttttcctttatttctctcccaacctggctgcaaaggaggttcatattccccagatgtgtccacaaacctgtccaggagttgtgtcttaaaattgatttcctgtccctcttcctaaggacaggggtaacagtcaaagtgaaggaatgatgggttcttgcctgtcttgctttggtccgtatttcccaagccctcctcttttagccaaggctacagggcacttgtcttccctggtggctctcccctttggagagagctagtggcagagcaacctagctaggtcctccttgggctttgaatgcaggagcacccagtgccccaggccttgcactgtgctgcccaaggagtattttctgggtggatctcccatactcctcagggttctgaggtccttgtatttagggtatggtgtaaaaacttacatatgcacattttgttacatcatttaagatgattgaagctttactggttaagtacagggtcaccagagaaagttcctttccccagttgatgtcttgaggctgttgagaaacttaggacagaagcctacctcatcccaggcctgcccctccgtgcatagctctgcctttgggtcttgttcatagtgctgttcaggcaaaatggaatagtctcaggtgggaacaccttctcttgctagctccaggaaggctttgtgggaaatgagttgagaccatggacttgggagttgggggccagagttgagcctggacttgaccaattaattcccttacctttcagcccaagatagctacatgtctttacttgctgtataagttttccttttgtcctgggggtgcctgattgatcctatctcttcacccttcattctttcaacaaacatgccatctatctcccaggacatttattcccttctattcaaggccagttaggaatgcaattattttttttttcagttaaatacagacttgtttggacgcaaggtaccctttctctttttaaaaactttttatcatgaaaactttcaaatacaaaaataaaatggtagagtgaacctccatgtacccag

SEQ ID NO: 307722 - DNA, 1598 bp, Homo sapiens
cttttttttttttgtaaacaggtccaaaagaacctttattactttttatgacttgccacttatgctttctcttgccaggaatgcccatggatcatgtgattggcttttctacccatagagggccttgcagcctgataccacctgggagtgagggtcacaaaggagaccttggctccctcaggtcaccaataaacctgttctttaatcaagtagttgtaatatggacctggggtacctttagttagggactctggtggcactacacggggtgctggattcaaatctcacctctatggatgatgtctggcatcgtctggcccctccttttccaaagtgaccagaagattgtacttcctagagatgccagacttgcctcacacccaggagctgcccctgctgtgcctggtatgctggcagtggtgatggtgacaacacaatgaggccaagtagcaatgctcccaggtcctgcagcttgtgctctgcccagcagtgcccctggcccagcacctcagcctgctcttctctctggtggctccaccccaacccctacttcttttcctttatttctctcccaacctggctgcaaaggaggttcatattccccagatgtgtccacaaacctgtccaggagttgtgtcttaaaattgatttcctgtccctcttcctaaggacaggggtaacagtcaaagtgaaggaatgatgggttcttgcctgtcttgctttggtccgtatttcccaagccctcctcttttagccaaggctacagggcacttgtcttccctggtggctctcccctttggagagagctagtggcagagcaacctagctaggtcctccttgggctttgaatgcaggagcacccagtgccccaggccttgcactgtgctgcccaaggagtattttctgggtggatctcccatactcctcagggttctgaggtccttgtatttagggtatggtgtaaaaacttacatatgcacattttgttacatcatttaagatgattgaagctttactggttaagtacagggtcaccagagaaagttcctttccccagttgatgtcttgaggctgttgagaaacttaggacagaagcctacctcatcccaggcctgcccctccgtgcatagctctgcctttgggtcttgttcatagtgctgttcaggcaaaatggaatagtctcaggtgggaacaccttctcttgctagctccaggaaggctttgtgggaaatgagttgagaccatggacttgggagttgggggccagagttgagcctggacttgaccaattaattcccttacctttcagcccaagatagctacatgtctttacttgctgtataagttttccttttgtcctgggggtgcctgattgatcctatctcttcacccttcattctttcaacaaacatgccatctatctcccaggacatttattcccttctattcaaggccagttaggaatgcaattattttttttttcagttaaatacagacttgtttggacgcaaggtaccctttctctttttaaaaactttttatcatgaaaactttcaaatacaaaaataaaatggtagagtgaacctccatgtacccag

SEQ ID NO: 307723 - DNA, 1553 bp, Homo sapiens
agcggcggcaggtctgaacgcttcggtaggataagtgcggtgggagggggctctgcggttttggggagcccagggcgggaacccggacccggctggaagtccggagcctggccgcagccccgcccctccgctctttcttggtgaccttaagccagtggctgcctttttctgagcccgggcggggccgaaggcggcccgtaggccctcgggactcccagcactgcagagggtgtgaggtctgacatccaagacacgttgtttcgtatttctgaaggaagaactcaagctccgggaagtgatggctggggatggggcgggcaacttggggaccgagtgtacgatccacgcctaaggttgagggcggccgagctagccaggcagccgtgaccccagtgcttttcagacgtttcttagcttccagagcccaacacatacagctgatacacgcagaccagatctggtcaggtcctcggaagctgagtccagagcgatgctgctgaagacagtgctcttgctgggacatgtggcccaggtgctgatgctggacaatgggctcctgcagacaccacccatgggctggctggcctgggaacgcttccgctgcaacattaactgtgatgaggacccaaagaactgcataagtgaacagctcttcatggagatggctgaccggatggcacaggatggatggcgggacatgggctacacatacctcaacattgatgactgctggatcggtggtcgcgatgccagtggccgcctgatgccagatcccaagcgcttccctcatggcattcctttcctggctgactacgttcactccctgggcctgaagttgggtatctacgcggacatgggcaacttcacctgcatgggttacccaggcaccacactggacaaggtggtccaggatgctcagaccttcgccgagtggaaggtagacatgctcaagctggatggctgcttctccacccccgaggagcgggcccaggggtaccccaagatggctgctgccctgaatgccacaggccgccccatcgccttctcctgcagctggccagcctatgaaggcggcctccccccaagggtgaactacagtctgctggcggacatctgcaacctctggcgtaactatgatgacatccaggactcctggtggagcgtgctctccatcctgaattggttcgtggagcaccaggacatactgcagccagtggccggccctgggcactggaatgaccctgacatgctgctcattgggaactttggtctcagcttagagcaatcccgggcccagatggccctgtggacggtgctggcagcccccctcttgatgtccacagacctgcgtaccatctccgcccagaacatggacattctgcagaatccactcatgatcaaaatcaaccaggatcccttaggcatccagggacgcaggattcacaaggtaatgaagatgttctggaattacagtacttacggttgcctatctttctgtacaaataacacatggcttttgcctcctgactggagcctttcaggtatacagagag

SEQ ID NO: 307724 - DNA, 1112 bp, Homo sapiens
agcggcggcaggtctgaacgcttcggtaggataagtgcggtgggagggggctctgcggttttggggagcccagggcgggaacccggacccggctggaagtccggagcctggccgcagccccgcccctccgctctttcttggtgaccttaagccagtggctgcctttttctgagcccgggcggggccgaaggcggcccgtaggccctcgggactcccagcactgcagagggtgtgaggtctgacatccaagacacgttgtttcgtatttctgaaggaagaactcaagctccgggaagtgatggctggggatggggcgggcaacttggggaccgagtgtacgatccacgcctaaggttgagggcggccgagctagccaggcagccgtgaccccagtgcttttcagacgtttcttagcttccagagcccaacacatacagctgatacacgcagaccagatctggtcaggtcctcggaagctgagtccagagcgatgctgctgaagacagtgctcttgctgggacatgtggcccaggtgctgatgctggacaatgggctcctgcagacaccacccatgggctggctggcctgggaacgcttccgctgcaacattaactgtgatgaggacccaaagaactgcataagtgaacagctcttcatggagatggctgaccggatggcacaggatggatggcgggacatgggctacacatacctcaacattgatgactgctggatcggtggtcgcgatgccagtggccgcctgatgccagatcccaagcgcttccctcatggcattcctttcctggctgactacgttcactccctgggcctgaagttgggtatctacgcggacatgggcaacttcacctgcatgggttacccaggcaccacactggacaaggtggtccaggatgctcagaccttcgccgagtggaaggtagacatgctcaagctggatggctgcttctccacccccgaggagcgggcccaggggtaccccaagatggctgctgccctgaatgccacaggccgccccatcgccttctcctgcagctggccagcctatgaaggcggcctccccccaagggtaagccattctgccccctgcctga

SEQ ID NO: 307725 - DNA, 1116 bp, Homo sapiens
agcggcggcaggtctgaacgcttcggtaggataagtgcggtgggagggggctctgcggttttggggagcccagggcgggaacccggacccggctggaagtccggagcctggccgcagccccgcccctccgctctttcttggtgaccttaagccagtggctgcctttttctgagcccgggcggggccgaaggcggcccgtaggccctcgggactcccagcactgcagagggtgtgaggtctgacatccaagacacgttgtttcgtatttctgaaggaagaactcaagctccgggaagtgatggctggggatggggcgggcaacttggggaccgagtgtacgatccacgcctaaggttgagggcggccgagctagccaggcagccgtgaccccagtgcttttcagacgtttcttagcttccagagcccaacacatacagctgatacacgcagaccagatctggtcaggtcctcggaagctgagtccagagcgatgctgctgaagacagtgctcttgctgggacatgtggcccaggtgctgatgctggacaatgggctcctgcagacaccacccatgggctggctggcctgggaacgcttccgctgcaacattaactgtgatgaggacccaaagaactgcataagtgaacagctcttcatggagatggctgaccggatggcacaggatggatggcgggacatgggctacacatacctcaacattgatgactgctggatcggtggtcgcgatgccagtggccgcctgatgccagatcccaagcgcttccctcatggcattcctttcctggctgactacccttcctggcctctacttccatgtgcgcagccccacagacgttgctgagcaactcgccagcctcctgagctccatgcccatcaggactctagcctctgaccttgctgttgactctgaaatcaggatttggaagttttcgaattaggagtagagagatctgacctcttgccaggaatgcccatggatcatgtgattggcttttctacccatagagggccttgcagcctgataccacctgggagtgagggtcacaaaggagaccttggctccctcaggtcaccaataaacctgttctttaatca

SEQ ID NO: 307726 - DNA, 478 bp, Homo sapiens
acttgctcgcataaaaaatttgtcacacttattgttaaatcctaatatgtagagaaatgtcctctgggttggaataggaaaatagggaattttaatgggaggagaagtaatttaaattcttaatctctccattgcagcctgtgaggcatgctacattaagcatgtagtatcattttattttgagctaagcaaggcacttaaatacaggctggaccagccgtgttaaaacaggcacatctctgcccaaattatcatgaagaaaagtgagcattgtgtttccctctggtttacatttaggatgtggatctggaccgccagtctttaagcagcatagataaaaatccctctgagaggggacagagccagctctctaacccaacagatgacagctggaagggtagaccatacgcaagtaaggccactttttaatttgttttaaataagtaacatgtttatgtgattcatatattcagaaggc

SEQ ID NO: 307727 - DNA, 516 bp, Homo sapiens
actgacatgcttttcttagattttcacagttaattatctctgatgtatgtgtgtgtgtgtgtgtgtgcacgcacgtgcattttttcatccccatttctaaatcctggtcttatgaaaaatgtgccttgtgttcccccagcaactattttccagcaccattttcctgcagccatcgattcctttcaggatgctgtgaagtgcttatcagagttcgcctgcaacgccgctttccctgacacgagcatggaagcgattcggctcatccgcttctgtggcaaatacgtctctgagaggcctcgggtgctacaagaatacacaagtgatgacatgaatgtagctcctggtgacagagtctgggtccgaggctggttccccatcttattcgaactctcctgcatcattaatagatgcaagttagatgtacgaacaaggtaaccatgttcccgtgcggtggccccttacatcactgaaatgaacctcagtcacttgctcacctgaccccactctcttctctgt

SEQ ID NO: 307728 - DNA, 8863 bp, Homo sapiens
atgcaggagagccagaccaagagcatgttcgtgtcccgggccctggagaagatcctagccgacaaggaggtgaagcggccccagcactcccagctgcgcagggcctgccaggtggcgctcgatgaaattaaagcagaaatagaaaagcagaggcttggcactgctgcaccaccaaaggcaaacttcattgaagctgacaagtattttcttccattcgagctagcttgccagtccaagtccccaagggtagtcagcacatcccttgactgcttgcagaaactcatcgcatacgggcacatcactggcaacgcccctgacagtggagcccctgggaagcggctgatcgacagaattgttgaaaccatttgcagttgttttcagggccctcagactgatgaaggggttcagttacaaataattaaggctcttctgactgcagtgacttccccacacattgaaattcatgagggtactatcctgcagacagtgagaacatgttacaatatctatttggccagcaaaaatctcatcaatcaaaccactgccaaggctacccttactcagatgctgaacgtcattttcacccgcatggaaaaccaagtgttgcaggaggccagagaactggaaaaaccaatccagtcaaaaccccagtcccctgtgatccaagctgcagcagtatccccaaagttcgttcgtttgaagcacagtcaggcacaaagcaaaccaacaactcccgaaaaaacagatttaaccaacggtgaacatgccaggagtgattctggaaaagtaagcacagaaaatggagacgcacccagagaaagaggctcatcactgtcagggactgatgacggagcccaggaggtggtgaaggacatcttggaagatgtagtcacatctgccattaaagaagcagcggaaaagcatggtctgacagaacctgagagagttctaggtgaactggagtgccaggaatgtgctattcccccaggagttgatgaaaactcacagaccaacgggatagccgatgacaggcagtccttgtcgtcagcagataatctggaatcggatgcacaaggacatcaagtggctgccaggttctcccacgttctgcagaaggatgccttccttgtgttccgctccctgtgcaagctgtccatgaaaccccttggtgaaggccctccagacccaaaatcccatgagctgcgttccaaggtggtttccctgcagctgctcctctctgtgttgcaaaatgctggccccgtattcaggactcacgagatgttcatcaatgcaatcaagcaatatctctgtgtggccttgtccaaaaacggcgtctcttcagtgcctgatgtctttgagctctctcttgccatttttcttactcttctttcaaactttaaaatgcacttgaaaatgcagatagaggtctttttcaaagagattttcctgaacattttagaaacatcaacaagttcttttgagcacaggtggatggtcattcagactctgacgaggatctgtgcagatgcccagtgtgttgtggatatttatgtcaactacgactgtgatttaaatgctgctaacatttttgagcgccttgtaaatgatttatccaaaattgctcagggaagaagtggacatgagctgggaatgacacctctgcaggagctcagcctgaggaagaaaggcctggagtgcctcgtgtccattctcaagtgcatggtggagtggagcaaagacctgtatgtgaatcccaaccaccagaccagcctcggtcaggagaggctcacggatcaggaaataggggatgggaaaggccttgacatggcaagacggtgtagtgtgacgtccatggagtccacagtgtcctcggggacccagacaactgttcaggatgaccctgagcaatttgaggtcatcaagcaacaaaaagaaatcattgaacacggcatcgagctgttcaacaagaaacccaagagggggatccagtttctccaggagcagggcatgctgggaacgtcagttgaagacatagcccaattcctgcaccaggaggagcgcctggattccacccaagtaggcgattttctgggagatagcgcaaggttcaacaaggaggtgatgtatgcctacgtggaccaacttgacttctgtgaaaaagaatttgtctcagccctgcggacattcctagaaggtttccgcctacctggagaagcccaaaagattgaccgattaatggagaagtttgccgcaagatacatagaatgcaaccaagggcaaactctgtttgctagtgctgacactgcttatgtcctagcgtattcaattattatgctgactacagacttgcacagtcctcaggtaaaaaataaaatgacgaaagagcagtatattaaaatgaatcggggtatcaatgatagtaaagatctgccagaagagtatctctcaagcatctatgaagagatagaaggcaagaaaattgcaatgaaagaaacaaaagagctaacgattgcaaccaaatctactaagcagaatgtagctagtgaaaagcagcggcggctgctgtacaacttagagatggagcaaatggctaaaacagccaaagctctgatggaggctgtgagccatgccaaagccccgtttaccagtgccactcacctggaccatgtccggccaatgttcaaactggtgtggacgccactattggcagcctacagcatcggactccagaactgtgatgacactgaagtggcctccttgtgtttggaaggcatccgatgtgcaatccgaatcgcctgcatctttggaatgcagctggaacgagatgcctatgttcaggctcttgctcgcttctccctactcacagccagctccagcatcacaaaaatgaagcagaaaaacatcgacaccattaagacgcttatcacagtggctcacaccgatggcaactaccttgggaattcctggcatgagatcttgaaatgcatcagccagctggagctcgctcagctgataggaaccggtgtgaagacgcgctacctgtctggatctgggcgtgaaagagaagggagcctgaagggccacacattggcaggagaagagttcatgggccttggcctcggtaatttggtgagtggcggagtggataaaagacagatggccagcttccaagaatcggttggtgagaccagctcgcagagtgtggttgtagctgtggacaggatttttactgggtctaccagactggatggaaatgcaatagttgactttgtccgctggctgtgtgctgtgtccatggatgaactggcttccccccaccatcctcgcatgttcagcttgcagaagattgtggagatatcatactacaacatgaatcggatccgactacagtggtctcgaatatggcatgtgattggagatcacttcaataaggttggctgcaaccctaatgaagatgtggctatctttgctgttgactcattaaggcaactctccatgaagtttcttgagaagggtgaattagccaacttccgtttccagaaagattttctgaggccctttgagcatattatgaagaaaaacaggtctcccaccatccgggacatggcgatccgctgcattgcccagatggtgaactcccaggcggccaacatccgctcaggttggaagaacatctttgccgtgttccaccaggcagcctctgatcatgatgggaacattgtggagctggccttccagaccacttgccacattgtcacaactattttccagcaccattttcctgcagccatcgattcctttcaggatgctgtgaagtgcttatcagagttcgcctgcaacgccgctttccctgacacgagcatggaagcgattcggctcatccgcttctgtggcaaatacgtctctgagaggcctcgggtgctacaagaatacacaagtgatgacatgaatgtagctcctggtgacagagtctgggtccgaggctggttccccatcttattcgaactctcctgcatcattaatagatgcaagttagatgtacgaacaaggggactcacagtcatgtttgagatcatgaagagctatggccacacctttgaaaagcactggtggcaggacctgttcagaatcgtgtttcggatttttgacaatatgaaactccctgagcaactgtcagagaaatctgagtggatgacaacaacctgcaatcacgcactttatgctatttgtgatgtttttacccagttttatgaagctttgaatgaagttcttctttctgatgtatttgcacaattgcagtggtgtgtcaaacaagataatgaacagttggcgcgatcaggtacaaattgcttagaaaacttagtaatatccaatggagagaaattcagtcctgaagtctgggatgaaacctgcaactgtatgttggatattttcaaaacaaccatcccacatgttttgctgacatggagacctgtaggaatggaggaagattcatcagaaaagcatttggatgtggatctggaccgccagtctttaagcagcatagataaaaatccctctgagaggggacagagccagctctctaacccaacagatgacagctggaagggtagaccatacgcaaatcagaaactgtttgccagcctcctcatcaagtgtgtggtccagttggaattgatacagaccattgacaacattgtgttctaccctgcgacgagcaaaaaggaggatgcagagcacatggttgccgcccagcaagacacgctggatgcagatatccacatagagacggaggatcagggcatgtataagtacatgtcttcccagcacctcttcaagctgttggactgtttgcaggaatcccattcattctcaaaggccttcaactccaattacgagcagcggactgtcctgtggcgagcaggttttaagggcaagtctaaacccaatcttctaaaacaagaaaccagcagcctggcctgttgtttgaggatcctgtttcgaatgtatgttgatgagaaccgcagggattcctgggaagaaatacagcagagacttttaactgtttgcagtgaagctcttgcctatttcatcactgtgaattctgagagccatcgggaggcctggacaagtctcttgttgttacttctaactaaaaccctcaaaataaatgatgaaaagttcaaagcacatgcttcaatgtactacccctacttgtgtgaaattatgcagtttgacctgatccctgagctccgagcagttctgcggaagttcttcctacggataggtgttgtgtataagatatggataccagaagagccatcacaggtaccagcagcactgtcaccagtgtggtagccctggctgcccaggccagtgctgcagctctgcagaatgttcagcatgccatttctgactggcacatctcgtgaagtttcatagaaacaaggagttggcatcttggatctcagaatggcctggaaacggatggcctctacgctgttccatcacagtctccaactaaggcttatggtatttcattaaactgttgcatacccagttagcacagtaggtggggagtctgcttcatttctatcattccatttttctgattaaactgtcaaatctgtcattgcatatgccatcgttttctagcaaaatcccatgattggctataaacgttttgtaagaagtcactctccttgaaaatactgaacatagctgtataggtttgtgattattagagaatatgttaataaaacttcttgtaacggctaactgccacctaaaatatgctgggttttctgttgtttgagtgtgttagagaaatttgaatgtttttgtcagttacgagtcagccgtaattagattagtttaaggacaggtcaggattagagaagagttgtttttgtgttttgttaatgtctgagtgatttttaaagtattttacaaaaagatattgaaaatttggttgaaggcagagtttagtaattaagttagaattaagagttttgcgaggttaaaaaaatgtgcctcgtggatctccctgttttagtaacatggagagaaaaagtctacacgaaaaagtgaacaatttaatgaagatgattagccttccttgaaataagtatttgtggatgggtgttaaattaaaatttccagaatacactgtccatctcacacactctgaaatctaatatatgaagtagtaatgaaaatgaagtagtaatttaaccagagttcatttatccttgaataaacctttttattttcacctcagaaaagtgagtgtactggcagttagtgtcactgctttgcacagtccccattaaaggaccctccagagagggacagtaactgtgcatgagaagccgctcccataagcctcctcagccagatgtcatgggtggaactggagctgtgtcggggccagcacagctgaactgtgacaatggcaggaggtggcatgtgcccagcacttccattaatctgagcctaggagttgaattctttggcaaggttggattctgaggtccttattatgttgaatgatggtgcaatactctcacctgcagtagaactgagttctgctgcagcttgtgtaaaagtgggcagtacacaagtacgtcccaaagcctgtgagcagtatacgtggatgctcacccatgagaaggagcacacacgcctcattctctgccctcacccactgctcacctagagcatcgctgagcgttagacaaagtgttacacagaatgattaaaactttcagacttctacctatgctctttagtcctgtaaattgggttgtattgatgtcaactctggtgccttagaagttagtagtttgggaacctatctgtaaaatcagatgttttttctttgtagagaaggatttctggtgcttttgcttactaagagaccgatattcttaagttgttttcttgttttaacagccttgagaaatgtttggttttggccagcagaattcttgtctacttttttctttcccaaaaagtgttttttaatttctctaccaaagaaaaaatgagcaggtttaggtttttacatgacttatatacattagataaaaggagctgtataatttagcaggaagggactatgggagaatactttactgtgagtggaaaatgttagcacatttgactggtttgccctggaatccactgcacctttacactgcaccatgaaacctacactccctggtatcatagcgcgtcatcacctcaacaagtcagtcgtctccattgatatttgtacaaaaggtatacatggggaacacgtgttcattcattaagtccatcttgcgtgcagctatatccctgattggttatttttcctttccttctgaggttctcatgtcattttcttcatcggatgtgactaaaatttttctggtgtcttctgccctctctttaattttgcctcttgaggggtagcagatgtgtcagtgcattttattacttgctgaaacattcaggcttacatttcttattagtttagtattttaaaagatttaattttctgaatgaggcatttgaattgtaccagcaatggacttttaaaaaattggatgtaaaaccattcagggtgatttttcttgtcagtggacagtgacgaacagagatttgaaatcccttacctccaataataagccattcagcctaaattcatttttatgaataaatctcttctttctcatggtaaatgtggcttgtgccactcaaacactagtgaaagggtatgtacaaccgcaacatcaggccaggacaccatttatttaaccaagtaatggaggagagtgaaacattttccaaggccttatttctttttcagaatgctttaagtgttgattatatgtgctgggtctctagagaagtttttatttgttacaatactgctgctttgagcaattttgtttctcttcattgtctgttagggaaatcaccagctttggcatcttaacaacaaacagtggatgggtaatttttatttctgatacgcatctttagagtcaaatatatcttttccctgtactcctcatgtacaaccaaagaacatacattatgaaaattgtattataatatctggaaacacaacattttcctctggcaggtgacttttgtacgaaatgaaaaaaaaaaaacctgtattttttttgttgttcttttgtgattaaggatatacatttagtagtctttgttattaaaggaacctgctgataagtacaagtgtgaccatctcattcaaatgtttgttgttatgatgcaaatggatattggtttcaatagaagctggatccttaatactgcattttctgaattctgttttaatatttgtgttaaagtagacatagctgaactcacatggaatcctggagttttgttatcagcagctttgcagtttgggaaacaaagaaaccaaagctgagtgttttaaagaatgaacatatctggaaatccttgctctcaaaacaaaacaatataatctatcaaaggtgttttactcagtgttctaatttttaaaaaattttatctgcatatttgcatcaaatatttatgtgtaaaatgtatgttttacctccttaaaatgcctaaaagttagttaatagttactttggtttaacctatacacaatgattaagtgcatttaatattggtaatttaatgaaaaccattccttgcccaatggatgtataaatttttgaaagaataagcagaattatataatatgaaatgctatgtaaagttttctatgtaaaaatattatgtataatactattaaaatatcccatgctttgatcaggtggtacatcaataaaattttaaaaagtaaaaaagttac

SEQ ID NO: 307729 - DNA, 8810 bp, Homo sapiens
atgcaggagagccagaccaagagcatgttcgtgtcccgggccctggagaagatcctagccgacaaggaggtgaagcggccccagcactcccagctgcgcagggcctgccaggtggcgctcgatgaaattaaagcagaaatagaaaagcagaggcttggcactgctgcaccaccaaaggcaaacttcattgaagctgacaagtattttcttccattcgagctagcttgccagtccaagtccccaagggtagtcagcacatcccttgactgcttgcagaaactcatcgcatacgggcacatcactggcaacgcccctgacagtggagcccctgggaagcggctgatcgacagaattgttgaaaccatttgcagttgttttcagggccctcagactgatgaaggggttcagttacaaataattaaggctcttctgactgcagtgacttccccacacattgaaattcatgagggtactatcctgcagacagtgagaacatgttacaatatctatttggccagcaaaaatctcatcaatcaaaccactgccaaggctacccttactcagatgctgaacgtcattttcacccgcatggaaaaccaagtgttgcaggaggccagagaactggaaaaaccaatccagtcaaaaccccagtcccctgtgatccaagctgcagcagtatccccaaagttcgttcgtttgaagcacagtcaggcacaaagcaaaccaacaactcccgaaaaaacagatttaaccaacggtgaacatgccaggagtgattctggaaaagtaagcacagaaaatggagacgcacccagagaaagaggctcatcactgtcagggactgatgacggagcccaggaggtggtgaaggacatcttggaagatgtagtcacatctgccattaaagaagcagcggaaaagcatggtctgacagaacctgagagagttctaggtgaactggagtgccaggaatgtgctattcccccaggagttgatgaaaactcacagaccaacgggatagccgatgacaggcagtccttgtcgtcagcagataatctggaatcggatgcacaaggacatcaagtggctgccaggttctcccacgttctgcagaaggatgccttccttgtgttccgctccctgtgcaagctgtccatgaaaccccttggtgaaggccctccagacccaaaatcccatgagctgcgttccaaggtggtttccctgcagctgctcctctctgtgttgcaaaatgctggccccgtattcaggactcacgagatgttcatcaatgcaatcaagcaatatctctgtgtggccttgtccaaaaacggcgtctcttcagtgcctgatgtctttgagctctctcttgccatttttcttactcttctttcaaactttaaaatgcacttgaaaatgcagatagaggtctttttcaaagagattttcctgaacattttagaaacatcaacaagttcttttgagcacaggtggatggtcattcagactctgacgaggatctgtgcagatgcccagtgtgttgtggatatttatgtcaactacgactgtgatttaaatgctgctaacatttttgagcgccttgtaaatgatttatccaaaattgctcagggaagaagtggacatgagctgggaatgacacctctgcaggagctcagcctgaggaagaaaggcctggagtgcctcgtgtccattctcaagtgcatggtggagtggagcaaagacctgtatgtgaatcccaaccaccagaccagcctcggtcaggagaggctcacggatcaggaaataggggatgggaaaggccttgacatggcaagacggtgtagtgtgacgtccatggagtccacagtgtcctcggggacccagacaactgttcaggatgaccctgagcaatttgaggtcatcaagcaacaaaaagaaatcattgaacacggcatcgagctgttcaacaagaaacccaagagggggatccagtttctccaggagcagggcatgctgggaacgtcagttgaagacatagcccaattcctgcaccaggaggagcgcctggattccacccaagtaggcgattttctgggagatagcgcaaggttcaacaaggaggtgatgtatgcctacgtggaccaacttgacttctgtgaaaaagaatttgtctcagccctgcggacattcctagaaggtttccgcctacctggagaagcccaaaagattgaccgattaatggagaagtttgccgcaagatacatagaatgcaaccaagggcaaactctgtttgctagtgctgacactgcttatgtcctagcgtattcaattattatgctgactacagacttgcacagtcctcaggtaaaaaataaaatgacgaaagagcagtatattaaaatgaatcggggtatcaatgatagtaaagatctgccagaagagtatctctcaagcatctatgaagagatagaaggcaagaaaattgcaatgaaagaaacaaaagagctaacgattgcaaccaaatctactaagcagaatgtagctagtgaaaagcagcggcggctgctgtacaacttagagatggagcaaatggctaaaacagccaaagctctgatggaggctgtgagccatgccaaagccccgtttaccagtgccactcacctggaccatgtccggccaatgttcaaactggtgtggacgccactattggcagcctacagcatcggactccagaactgtgatgacactgaagtggcctccttgtgtttggaaggcatccgatgtgcaatccgaatcgcctgcatctttggaatgcagctggaacgagatgcctatgttcaggctcttgctcgcttctccctactcacagccagctccagcatcacaaaaatgaagcagaaaaacatcgacaccattaagacgcttatcacagtggctcacaccgatggcaactaccttgggaattcctggcatgagatcttgaaatgcatcagccagctggagctcgctcagctgataggaaccggtgtgaagacgcgctacctgtctggatctgggcgtgaaagagaagggagcctgaagggccacacattggcaggagaagagttcatgggccttggcctcggtaatttggtgagtggcggagtggataaaagacagatggccagcttccaagaatcggttggtgagaccagctcgcagagtgtggttgtagctgtggacaggatttttactgggtctaccagactggatggaaatgcaatagttgactttgtccgctggctgtgtgctgtgtccatggatgaactggcttccccccaccatcctcgcatgttcagcttgcagaagattgtggagatatcatactacaacatgaatcggatccgactacagtggtctcgaatatggcatgtgattggagatcacttcaataaggttggctgcaaccctaatgaagatgtggctatctttgctgttgactcattaaggcaactctccatgaagtttcttgagaagggtgaattagccaacttccgtttccagaaagattttctgaggccctttgagcatattatgaagaaaaacaggtctcccaccatccgggacatggcgatccgctgcattgcccagatggtgaactcccaggcggccaacatccgctcaggttggaagaacatctttgccgtgttccaccaggcagcctctgatcatgatgggaacattgtggagctggccttccagaccacttgccacattgtcacaactattttccagcaccattttcctgcagccatcgattcctttcaggatgctgtgaagtgcttatcagagttcgcctgcaacgccgctttccctgacacgagcatggaagcgattcggctcatccgcttctgtggcaaatacgtctctgagaggcctcgggtgctacaagaatacacaagtgatgacatgaatgtagctcctggtgacagagtctgggtccgaggctggttccccatcttattcgaactctcctgcatcattaatagatgcaagttagatgtacgaacaaggggactcacagtcatgtttgagatcatgaagagctatggccacacctttgaaaagcactggtggcaggacctgttcagaatcgtgtttcggatttttgacaatatgaaactccctgagcaactgtcagagaaatctgagtggatgacaacaacctgcaatcacgcactttatgctatttgtgatgtttttacccagttttatgaagctttgaatgaagttcttctttctgatgtatttgcacaattgcagtggtgtgtcaaacaagataatgaacagttggcgcgatcaggtacaaattgcttagaaaacttagtaatatccaatggagagaaattcagtcctgaagtctgggatgaaacctgcaactgtatgttggatattttcaaaacaaccatcccacatgttttgctgacatggagacctgtaggaatggaggaagattcatcagaaaagcatttggatgtggatctggaccgccagtctttaagcagcatagataaaaatccctctgagaggggacagagccagctctctaacccaacagatgacagctggaagggtagaccatacgcaaatcagaaactgtttgccagcctcctcatcaagtgtgtggtccagttggaattgatacagaccattgacaacattgtgttctaccctgcgacgagcaaaaaggaggatgcagagcacatggttgccgcccagcaagacacgctggatgcagatatccacatagagacggaggatcagggcatgtataagtacatgtcttcccagcacctcttcaagctgttggactgtttgcaggaatcccattcattctcaaaggccttcaactccaattacgagcagcggactgtcctgtggcgagcaggttttaagggcaagtctaaacccaatcttctaaaacaagaaaccagcagcctggcctgttgtttgaggatcctgtttcgaatgtatgttgatgagaaccgcagggattcctgggaagaaatacagcagagacttttaactgtttgcagtgaagctcttgcctatttcatcactgtgaattctgagagccatcgggaggcctggacaagtctcttgttgttacttctaactaaaaccctcaaaataaatgatgaaaagttcaaagcacatgcttcaatgtactacccctacttgtgtgaaattatgcagtttgacctgatccctgagctccgagcagttctgcggaagttcttcctacggataggtgttgtgtataagatatggataccagaagagccatcacaggtaccagcagcactgtcaccagtgtggtagccctggctgcccaggccagtgctgcagctctgcagaatgttcagcatgccatttctgactggcacatctcgtgaagtttcatagaaacaaggagttggcatcttggatctcagaatggcctggaaacggatggcctctacgctgttccatcacagtctccaactaaggcttatggtatttcattaaactgttgcatacccagttagcacagtaggtggggagtctgcttcatttctatcattccatttttctgattaaactgtcaaatctgtcattgcatatgccatcgttttctagcaaaatcccatgattggctataaacgttttgtaagaagtcactctccttgaaaatactgaacatagctgtataggtttgtgattattagagaatatgttaataaaacttcttgtaacggctaactgccacctaaaatatgctgggttttctgttgtttgagtgtgttagagaaatttgaatgtttttgtcagttacgagtcagccgtaattagattagtttaaggacaggtcaggattagagaagagttgtttttgtgttttgttaatgtctgagtgatttttaaagtattttacaaaaagatattgaaaatttggttgaaggcagagtttagtaattaagttagaattaagagttttgcgaggttaaaaaaatgtgcctcgtggatctccctgttttagtaacatggagagaaaaagtctacacgaaaaagtgaacaatttaatgaagatgattagccttccttgaaataagtatttgtggatgggtgttaaattaaaatttccagaatacactgtccatctcacacactctgaaatctaatatatgaagtagtaatgaaaatgaagtagtaatttaaccagagttcatttatccttgaataaacctttttattttcacctcagaaaagtgagtgtactggcagttagtgtcactgctttgcacagtccccattaaaggaccctccagagagggacagtaactgtgcatgagaagccgctcccataagcctcctcagccagatgtcatgggtggaactggagctgtgtcggggccagcacagctgaactgtgacaatggcaggaggtggcatgtgcccagcacttccattaatctgagcctaggagttgaattctttggcaaggttggattctgaggtccttattatgttgaatgatggtgcaatactctcacctgcagtagaactgagttctgctgcagcttgtgtaaaagtgggcagtacacaagtacgtcccaaagcctgtgagcagtatacgtggatgctcacccatgagaaggagcacacacgcctcattctctgccctcacccactgctcacctagagcatcgctgagcgttagacaaagtgttacacagaatgattaaaactttcagacttctacctatgctctttagtcctgtaaattgggttgtattgatgtcaactctggtgccttagaagttagtagtttgggaacctatctgtaaaatcagatgttttttctttgtagagaaggatttctggtgcttttgcttactaagagaccgatattcttaagttgttttcttgttttaacagccttgagaaatgtttggttttggccagcagaattcttgtctacttttttctttcccaaaaagtgttttttaatttctctaccaaagaaaaaatgagcaggtttaggtttttacatgacttatatacattagataaaaggagctgtataatttagcaggaagggactatgggagaatactttactgtgagtggaaaatgttagcacatttgactggtttgccctggaatccactgcacctttacactgcaccatgaaacctacactccctggtatcatagcgcgtcatcacctcaacaagtcagtcgtctccattgatatttgtacaaaaggtatacatggggaacacgtgttcattcattaagtccatcttgcgtgcagctatatccctgattggttatttttcctttccttctgaggttctcatgtcattttcttcatcggatgtgactaaaatttttctggtgtcttctgccctctctttaattttgcctcttgaggggtagcagatgtgtcagtgcattttattacttgctgaaacattcaggcttacatttcttattagtttagtattttaaaagatttaattttctgaatgaggcatttgaattgtaccagcaatggacttttaaaaaattggatgtgaaatcccttacctccaataataagccattcagcctaaattcatttttatgaataaatctcttctttctcatggtaaatgtggcttgtgccactcaaacactagtgaaagggtatgtacaaccgcaacatcaggccaggacaccatttatttaaccaagtaatggaggagagtgaaacattttccaaggccttatttctttttcagaatgctttaagtgttgattatatgtgctgggtctctagagaagtttttatttgttacaatactgctgctttgagcaattttgtttctcttcattgtctgttagggaaatcaccagctttggcatcttaacaacaaacagtggatgggtaatttttatttctgatacgcatctttagagtcaaatatatcttttccctgtactcctcatgtacaaccaaagaacatacattatgaaaattgtattataatatctggaaacacaacattttcctctggcaggtgacttttgtacgaaatgaaaaaaaaaaaacctgtattttttttgttgttcttttgtgattaaggatatacatttagtagtctttgttattaaaggaacctgctgataagtacaagtgtgaccatctcattcaaatgtttgttgttatgatgcaaatggatattggtttcaatagaagctggatccttaatactgcattttctgaattctgttttaatatttgtgttaaagtagacatagctgaactcacatggaatcctggagttttgttatcagcagctttgcagtttgggaaacaaagaaaccaaagctgagtgttttaaagaatgaacatatctggaaatccttgctctcaaaacaaaacaatataatctatcaaaggtgttttactcagtgttctaatttttaaaaaattttatctgcatatttgcatcaaatatttatgtgtaaaatgtatgttttacctccttaaaatgcctaaaagttagttaatagttactttggtttaacctatacacaatgattaagtgcatttaatattggtaatttaatgaaaaccattccttgcccaatggatgtataaatttttgaaagaataagcagaattatataatatgaaatgctatgtaaagttttctatgtaaaaatattatgtataatactattaaaatatcccatgctttgatcaggtggtacatcaataaaattttaaaaagtaaaaaagttac

SEQ ID NO: 307730 - DNA, 8673 bp, Homo sapiens
atgcaggagagccagaccaagagcatgttcgtgtcccgggccctggagaagatcctagccgacaaggaggtgaagcggccccagcactcccagctgcgcagggcctgccaggtggcgctcgatgaaattaaagcagaaatagaaaagcagaggcttggcactgctgcaccaccaaaggcaaacttcattgaagctgacaagtattttcttccattcgagctagcttgccagtccaagtccccaagggtagtcagcacatcccttgactgcttgcagaaactcatcgcatacgggcacatcactggcaacgcccctgacagtggagcccctgggaagcggctgatcgacagaattgttgaaaccatttgcagttgttttcagggccctcagactgatgaaggggttcagttacaaataattaaggctcttctgactgcagtgacttccccacacattgaaattcatgagggtactatcctgcagacagtgagaacatgttacaatatctatttggccagcaaaaatctcatcaatcaaaccactgccaaggctacccttactcagatgctgaacatgccaggagtgattctggaaaagtaagcacagaaaatggagacgcacccagagaaagaggctcatcactgtcagggactgatgacggagcccaggaggtggtgaaggacatcttggaagatgtagtcacatctgccattaaagaagcagcggaaaagcatggtctgacagaacctgagagagttctaggtgaactggagtgccaggaatgtgctattcccccaggagttgatgaaaactcacagaccaacgggatagccgatgacaggcagtccttgtcgtcagcagataatctggaatcggatgcacaaggacatcaagtggctgccaggttctcccacgttctgcagaaggatgccttccttgtgttccgctccctgtgcaagctgtccatgaaaccccttggtgaaggccctccagacccaaaatcccatgagctgcgttccaaggtggtttccctgcagctgctcctctctgtgttgcaaaatgctggccccgtattcaggactcacgagatgttcatcaatgcaatcaagcaatatctctgtgtggccttgtccaaaaacggcgtctcttcagtgcctgatgtctttgagctctctcttgccatttttcttactcttctttcaaactttaaaatgcacttgaaaatgcagatagaggtctttttcaaagagattttcctgaacattttagaaacatcaacaagttcttttgagcacaggtggatggtcattcagactctgacgaggatctgtgcagatgcccagtgtgttgtggatatttatgtcaactacgactgtgatttaaatgctgctaacatttttgagcgccttgtaaatgatttatccaaaattgctcagggaagaagtggacatgagctgggaatgacacctctgcaggagctcagcctgaggaagaaaggcctggagtgcctcgtgtccattctcaagtgcatggtggagtggagcaaagacctgtatgtgaatcccaaccaccagaccagcctcggtcaggagaggctcacggatcaggaaataggggatgggaaaggccttgacatggcaagacggtgtagtgtgacgtccatggagtccacagtgtcctcggggacccagacaactgttcaggatgaccctgagcaatttgaggtcatcaagcaacaaaaagaaatcattgaacacggcatcgagctgttcaacaagaaacccaagagggggatccagtttctccaggagcagggcatgctgggaacgtcagttgaagacatagcccaattcctgcaccaggaggagcgcctggattccacccaagtaggcgattttctgggagatagcgcaaggttcaacaaggaggtgatgtatgcctacgtggaccaacttgacttctgtgaaaaagaatttgtctcagccctgcggacattcctagaaggtttccgcctacctggagaagcccaaaagattgaccgattaatggagaagtttgccgcaagatacatagaatgcaaccaagggcaaactctgtttgctagtgctgacactgcttatgtcctagcgtattcaattattatgctgactacagacttgcacagtcctcaggtaaaaaataaaatgacgaaagagcagtatattaaaatgaatcggggtatcaatgatagtaaagatctgccagaagagtatctctcaagcatctatgaagagatagaaggcaagaaaattgcaatgaaagaaacaaaagagctaacgattgcaaccaaatctactaagcagaatgtagctagtgaaaagcagcggcggctgctgtacaacttagagatggagcaaatggctaaaacagccaaagctctgatggaggctgtgagccatgccaaagccccgtttaccagtgccactcacctggaccatgtccggccaatgttcaaactggtgtggacgccactattggcagcctacagcatcggactccagaactgtgatgacactgaagtggcctccttgtgtttggaaggcatccgatgtgcaatccgaatcgcctgcatctttggaatgcagctggaacgagatgcctatgttcaggctcttgctcgcttctccctactcacagccagctccagcatcacaaaaatgaagcagaaaaacatcgacaccattaagacgcttatcacagtggctcacaccgatggcaactaccttgggaattcctggcatgagatcttgaaatgcatcagccagctggagctcgctcagctgataggaaccggtgtgaagacgcgctacctgtctggatctgggcgtgaaagagaagggagcctgaagggccacacattggcaggagaagagttcatgggccttggcctcggtaatttggtgagtggcggagtggataaaagacagatggccagcttccaagaatcggttggtgagaccagctcgcagagtgtggttgtagctgtggacaggatttttactgggtctaccagactggatggaaatgcaatagttgactttgtccgctggctgtgtgctgtgtccatggatgaactggcttccccccaccatcctcgcatgttcagcttgcagaagattgtggagatatcatactacaacatgaatcggatccgactacagtggtctcgaatatggcatgtgattggagatcacttcaataaggttggctgcaaccctaatgaagatgtggctatctttgctgttgactcattaaggcaactctccatgaagtttcttgagaagggtgaattagccaacttccgtttccagaaagattttctgaggccctttgagcatattatgaagaaaaacaggtctcccaccatccgggacatggcgatccgctgcattgcccagatggtgaactcccaggcggccaacatccgctcaggttggaagaacatctttgccgtgttccaccaggcagcctctgatcatgatgggaacattgtggagctggccttccagaccacttgccacattgtcacaactattttccagcaccattttcctgcagccatcgattcctttcaggatgctgtgaagtgcttatcagagttcgcctgcaacgccgctttccctgacacgagcatggaagcgattcggctcatccgcttctgtggcaaatacgtctctgagaggcctcgggtgctacaagaatacacaagtgatgacatgaatgtagctcctggtgacagagtctgggtccgaggctggttccccatcttattcgaactctcctgcatcattaatagatgcaagttagatgtacgaacaaggggactcacagtcatgtttgagatcatgaagagctatggccacacctttgaaaagcactggtggcaggacctgttcagaatcgtgtttcggatttttgacaatatgaaactccctgagcaactgtcagagaaatctgagtggatgacaacaacctgcaatcacgcactttatgctatttgtgatgtttttacccagttttatgaagctttgaatgaagttcttctttctgatgtatttgcacaattgcagtggtgtgtcaaacaagataatgaacagttggcgcgatcaggtacaaattgcttagaaaacttagtaatatccaatggagagaaattcagtcctgaagtctgggatgaaacctgcaactgtatgttggatattttcaaaacaaccatcccacatgttttgctgacatggagacctgtaggaatggaggaagattcatcagaaaagcatttggatgtggatctggaccgccagtctttaagcagcatagataaaaatccctctgagaggggacagagccagctctctaacccaacagatgacagctggaagggtagaccatacgcaaatcagaaactgtttgccagcctcctcatcaagtgtgtggtccagttggaattgatacagaccattgacaacattgtgttctaccctgcgacgagcaaaaaggaggatgcagagcacatggttgccgcccagcaagacacgctggatgcagatatccacatagagacggaggatcagggcatgtataagtacatgtcttcccagcacctcttcaagctgttggactgtttgcaggaatcccattcattctcaaaggccttcaactccaattacgagcagcggactgtcctgtggcgagcaggttttaagggcaagtctaaacccaatcttctaaaacaagaaaccagcagcctggcctgttgtttgaggatcctgtttcgaatgtatgttgatgagaaccgcagggattcctgggaagaaatacagcagagacttttaactgtttgcagtgaagctcttgcctatttcatcactgtgaattctgagagccatcgggaggcctggacaagtctcttgttgttacttctaactaaaaccctcaaaataaatgatgaaaagttcaaagcacatgcttcaatgtactacccctacttgtgtgaaattatgcagtttgacctgatccctgagctccgagcagttctgcggaagttcttcctacggataggtgttgtgtataagatatggataccagaagagccatcacaggtaccagcagcactgtcaccagtgtggtagccctggctgcccaggccagtgctgcagctctgcagaatgttcagcatgccatttctgactggcacatctcgtgaagtttcatagaaacaaggagttggcatcttggatctcagaatggcctggaaacggatggcctctacgctgttccatcacagtctccaactaaggcttatggtatttcattaaactgttgcatacccagttagcacagtaggtggggagtctgcttcatttctatcattccatttttctgattaaactgtcaaatctgtcattgcatatgccatcgttttctagcaaaatcccatgattggctataaacgttttgtaagaagtcactctccttgaaaatactgaacatagctgtataggtttgtgattattagagaatatgttaataaaacttcttgtaacggctaactgccacctaaaatatgctgggttttctgttgtttgagtgtgttagagaaatttgaatgtttttgtcagttacgagtcagccgtaattagattagtttaaggacaggtcaggattagagaagagttgtttttgtgttttgttaatgtctgagtgatttttaaagtattttacaaaaagatattgaaaatttggttgaaggcagagtttagtaattaagttagaattaagagttttgcgaggttaaaaaaatgtgcctcgtggatctccctgttttagtaacatggagagaaaaagtctacacgaaaaagtgaacaatttaatgaagatgattagccttccttgaaataagtatttgtggatgggtgttaaattaaaatttccagaatacactgtccatctcacacactctgaaatctaatatatgaagtagtaatgaaaatgaagtagtaatttaaccagagttcatttatccttgaataaacctttttattttcacctcagaaaagtgagtgtactggcagttagtgtcactgctttgcacagtccccattaaaggaccctccagagagggacagtaactgtgcatgagaagccgctcccataagcctcctcagccagatgtcatgggtggaactggagctgtgtcggggccagcacagctgaactgtgacaatggcaggaggtggcatgtgcccagcacttccattaatctgagcctaggagttgaattctttggcaaggttggattctgaggtccttattatgttgaatgatggtgcaatactctcacctgcagtagaactgagttctgctgcagcttgtgtaaaagtgggcagtacacaagtacgtcccaaagcctgtgagcagtatacgtggatgctcacccatgagaaggagcacacacgcctcattctctgccctcacccactgctcacctagagcatcgctgagcgttagacaaagtgttacacagaatgattaaaactttcagacttctacctatgctctttagtcctgtaaattgggttgtattgatgtcaactctggtgccttagaagttagtagtttgggaacctatctgtaaaatcagatgttttttctttgtagagaaggatttctggtgcttttgcttactaagagaccgatattcttaagttgttttcttgttttaacagccttgagaaatgtttggttttggccagcagaattcttgtctacttttttctttcccaaaaagtgttttttaatttctctaccaaagaaaaaatgagcaggtttaggtttttacatgacttatatacattagataaaaggagctgtataatttagcaggaagggactatgggagaatactttactgtgagtggaaaatgttagcacatttgactggtttgccctggaatccactgcacctttacactgcaccatgaaacctacactccctggtatcatagcgcgtcatcacctcaacaagtcagtcgtctccattgatatttgtacaaaaggtatacatggggaacacgtgttcattcattaagtccatcttgcgtgcagctatatccctgattggttatttttcctttccttctgaggttctcatgtcattttcttcatcggatgtgactaaaatttttctggtgtcttctgccctctctttaattttgcctcttgaggggtagcagatgtgtcagtgcattttattacttgctgaaacattcaggcttacatttcttattagtttagtattttaaaagatttaattttctgaatgaggcatttgaattgtaccagcaatggacttttaaaaaattggatgtaaaaccattcagggtgatttttcttgtcagtggacagtgacgaacagagatttgaaatcccttacctccaataataagccattcagcctaaattcatttttatgaataaatctcttctttctcatggtaaatgtggcttgtgccactcaaacactagtgaaagggtatgtacaaccgcaacatcaggccaggacaccatttatttaaccaagtaatggaggagagtgaaacattttccaaggccttatttctttttcagaatgctttaagtgttgattatatgtgctgggtctctagagaagtttttatttgttacaatactgctgctttgagcaattttgtttctcttcattgtctgttagggaaatcaccagctttggcatcttaacaacaaacagtggatgggtaatttttatttctgatacgcatctttagagtcaaatatatcttttccctgtactcctcatgtacaaccaaagaacatacattatgaaaattgtattataatatctggaaacacaacattttcctctggcaggtgacttttgtacgaaatgaaaaaaaaaaaacctgtattttttttgttgttcttttgtgattaaggatatacatttagtagtctttgttattaaaggaacctgctgataagtacaagtgtgaccatctcattcaaatgtttgttgttatgatgcaaatggatattggtttcaatagaagctggatccttaatactgcattttctgaattctgttttaatatttgtgttaaagtagacatagctgaactcacatggaatcctggagttttgttatcagcagctttgcagtttgggaaacaaagaaaccaaagctgagtgttttaaagaatgaacatatctggaaatccttgctctcaaaacaaaacaatataatctatcaaaggtgttttactcagtgttctaatttttaaaaaattttatctgcatatttgcatcaaatatttatgtgtaaaatgtatgttttacctccttaaaatgcctaaaagttagttaatagttactttggtttaacctatacacaatgattaagtgcatttaatattggtaatttaatgaaaaccattccttgcccaatggatgtataaatttttgaaagaataagcagaattatataatatgaaatgctatgtaaagttttctatgtaaaaatattatgtataatactattaaaatatcccatgctttgatcaggtggtacatcaataaaattttaaaaagtaaaaaagttac

SEQ ID NO: 307731 - DNA, 8814 bp, Homo sapiens
atgcaggagagccagaccaagagcatgttcgtgtcccgggccctggagaagatcctagccgacaaggaggtgaagcggccccagcactcccagctgcgcagggcctgccaggtggcgctcgatgaaattaaagcagaaatagaaaagcagaggcttggcactgctgcaccaccaaaggcaaacttcattgaagctgacaagtattttcttccattcgagctagcttgccagtccaagtccccaagggtagtcagcacatcccttgactgcttgcagaaactcatcgcatacgggcacatcactggcaacgcccctgacagtggagcccctgggaagcggctgatcgacagaattgttgaaaccatttgcagttgttttcagggccctcagactgatgaaggggttcagttacaaataattaaggctcttctgactgcagtgacttccccacacattgaaattcatgagggtactatcctgcagacagtgagaacatgttacaatatctatttggccagcaaaaatctcatcaatcaaaccactgccaaggctacccttactcagatgctgaacgtcattttcacccgcatggaaaaccaagtgttgcaggaggccagagaactggaaaaaccaatccagtcaaaaccccagtcccctgtgatccaagctgcagcagtatccccaaagttcgttcgtttgaagcacagtcaggcacaaagcaaaccaacaactcccgaaaaaacagatttaaccaacggtgaacatgccaggagtgattctggaaaagtaagcacagaaaatggagacgcacccagagaaagaggctcatcactgtcagggactgatgacggagcccaggaggtggtgaaggacatcttggaagatgtagtcacatctgccattaaagaagcagcggaaaagcatggtctgacagaacctgagagagttctaggtgaactggagtgccaggaatgtgctattcccccaggagttgatgaaaactcacagaccaacgggatagccgatgacaggcagtccttgtcgtcagcagataatctggaatcggatgcacaaggacatcaagtggctgccaggttctcccacgttctgcagaaggatgccttccttgtgttccgctccctgtgcaagctgtccatgaaaccccttggtgaaggccctccagacccaaaatcccatgagctgcgttccaaggtggtttccctgcagctgctcctctctgtgttgcaaaatgctggccccgtattcaggactcacgagatgttcatcaatgcaatcaagcaatatctctgtgtggccttgtccaaaaacggcgtctcttcagtgcctgatgtctttgagctctctcttgccatttttcttactcttctttcaaactttaaaatgcacttgaaaatgcagatagaggtctttttcaaagagattttcctgaacattttagaaacatcaacaagttcttttgagcacaggtggatggtcattcagactctgacgaggatctgtgcagatgcccagtgtgttgtggatatttatgtcaactacgactgtgatttaaatgctgctaacatttttgagcgccttgtaaatgatttatccaaaattgctcagggaagaagtggacatgagctgggaatgacacctctgcaggagctcagcctgaggaagaaaggcctggagtgcctcgtgtccattctcaagtgcatggtggagtggagcaaagacctgtatgtgaatcccaaccaccagaccagcctcggtcaggagaggctcacggatcaggaaataggggatgggaaaggccttgacatggcaagacggtgtagtgtgacgtccatggagtccacagtgtcctcggggacccagacaactgttcaggatgaccctgagcaatttgaggtcatcaagcaacaaaaagaaatcattgaacacggcatcgagctgttcaacaagaaacccaagagggggatccagtttctccaggagcagggcatgctgggaacgtcagttgaagacatagcccaattcctgcaccaggaggagcgcctggattccacccaagtaggcgattttctgggagatagcgcaaggttcaacaaggaggtgatgtatgcctacgtggaccaacttgacttctgtgaaaaagaatttgtctcagccctgcggacattcctagaaggtttccgcctacctggagaagcccaaaagattgaccgattaatggagaagtttgccgcaagatacatagaatgcaaccaagggcaaactctgtttgctagtgctgacactgcttatgtcctagcgtattcaattattatgctgactacagacttgcacagtcctcaggtaaaaaataaaatgacgaaagagcagtatattaaaatgaatcggggtatcaatgatagtaaagatctgccagaagagtatctctcaagcatctatgaagagatagaaggcaagaaaattgcaatgaaagaaacaaaagagctaacgattgcaaccaaatctactaagcagaatgtagctagtgaaaagcagcggcggctgctgtacaacttagagatggagcaaatggctaaaacagccaaagctctgatggaggctgtgagccatgccaaagccccgtttaccagtgccactcacctggaccatgtccggccaatgttcaaactggtgtggacgccactattggcagcctacagcatcggactccagaactgtgatgacactgaagtggcctccttgtgtttggaaggcatccgatgtgcaatccgaatcgcctgcatctttggaatgcagctggaacgagatgcctatgttcaggctcttgctcgcttctccctactcacagccagctccagcatcacaaaaatgaagcagaaaaacatcgacaccattaagacgcttatcacagtggctcacaccgatggcaactaccttgggaattcctggcatgagatcttgaaatgcatcagccagctggagctcgctcagctgataggaaccggtgtgaagacgcgctacctgtctggatctgggcgtgaaagagaagggagcctgaagggccacacattggcaggagaagagttcatgggccttggcctcggtaatttggtgagtggcggagtggataaaagacagatggccagcttccaagaatcggttggtgagaccagctcgcagagtgtggttgtagctgtggacaggatttttactgggtctaccagactggatggaaatgcaatagttgactttgtccgctggctgtgtgctgtgtccatggatgaactggcttccccccaccatcctcgcatgttcagcttgcagaagattgtggagatatcatactacaacatgaatcggatccgactacagtggtctcgaatatggcatgtgattggagatcacttcaataaggttggctgcaaccctaatgaagatgtggctatctttgctgttgactcattaaggcaactctccatgaagtttcttgagaagggtgaattagccaacttccgtttccagaaagattttctgaggccctttgagcatattatgaagaaaaacaggtctcccaccatccgggacatggcgatccgctgcattgcccagatggtgaactcccaggcggccaacatccgctcaggttggaagaacatctttgccgtgttccaccaggcagcctctgatcatgatgggaacattgtggagctggccttccagaccacttgccacattgtcacaactattttccagcaccattttcctgcagccatcgattcctttcaggatgctgtgaagtgcttatcagagttcgcctgcaacgccgctttccctgacacgagcatggaagcgattcggctcatccgcttctgtggcaaatacgtctctgagaggcctcgggtgctacaagaatacacaagtgatgacatgaatgtagctcctggtgacagagtctgggtccgaggctggttccccatcttattcgaactctcctgcatcattaatagatgcaagttagatgtacgaacaaggggactcacagtcatgtttgagatcatgaagagctatggccacacctttgaaaagcactggtggcaggacctgttcagaatcgtgtttcggatttttgacaatatgaaactccctgagcaactgtcagagaaatctgagtggatgacaacaacctgcaatcacgcactttatgctatttgtgatgtttttacccagttttatgaagctttgaatgaagttcttctttctgatgtatttgcacaattgcagtggtgtgtcaaacaagataatgaacagttggcgcgatcaggtacaaattgcttagaaaacttagtaatatccaatggagagaaattcagtcctgaagtctgggatgaaacctgcaactgtatgttggatattttcaaaacaaccatcccacatgttttgctgacatggagacctgtaggaatggaggaagattcatcagaaaagcatttggatgtggatctggaccgccagtctttaagcagcatagataaaaatccctctgagaggggacagagccagctctctaacccaacagatgacagctggaagggtagaccatacgcaaatcagaaactgtttgccagcctcctcatcaagtgtgtggtccagttggaattgatacagaccattgacaacattgtgttctaccctgcgacgagcaaaaaggaggatgcagagcacatggttgccgcccagcaagacacgctggatgcagatatccacatagagacggaggatcagggcatgtataagtacatgtcttcccagcacctcttcaagctgttggactgtttgcaggaatcccattcattctcaaaggccttcaactccaattacgagcagcggactgtcctgtggcgagcaggttttaagggcaagtctaaacccaatcttctaaaacaagaaaccagcagcctggcctgttgtttgaggatcctgtttcgaatgtatgttgatgagaaccgcagggattcctgggaagaaatacagcagagacttttaactgtttgcagtgaagctcttgcctatttcatcactgtgaattctgagagccatcgggaggcctggacaagtctcttgttgttacttctaactaaaaccctcaaaataaatgatgaaaagagtttgacctgatccctgagctccgagcagttctgcggaagttcttcctacggataggtgttgtgtataagatatggataccagaagagccatcacaggtaccagcagcactgtcaccagtgtggtagccctggctgcccaggccagtgctgcagctctgcagaatgttcagcatgccatttctgactggcacatctcgtgaagtttcatagaaacaaggagttggcatcttggatctcagaatggcctggaaacggatggcctctacgctgttccatcacagtctccaactaaggcttatggtatttcattaaactgttgcatacccagttagcacagtaggtggggagtctgcttcatttctatcattccatttttctgattaaactgtcaaatctgtcattgcatatgccatcgttttctagcaaaatcccatgattggctataaacgttttgtaagaagtcactctccttgaaaatactgaacatagctgtataggtttgtgattattagagaatatgttaataaaacttcttgtaacggctaactgccacctaaaatatgctgggttttctgttgtttgagtgtgttagagaaatttgaatgtttttgtcagttacgagtcagccgtaattagattagtttaaggacaggtcaggattagagaagagttgtttttgtgttttgttaatgtctgagtgatttttaaagtattttacaaaaagatattgaaaatttggttgaaggcagagtttagtaattaagttagaattaagagttttgcgaggttaaaaaaatgtgcctcgtggatctccctgttttagtaacatggagagaaaaagtctacacgaaaaagtgaacaatttaatgaagatgattagccttccttgaaataagtatttgtggatgggtgttaaattaaaatttccagaatacactgtccatctcacacactctgaaatctaatatatgaagtagtaatgaaaatgaagtagtaatttaaccagagttcatttatccttgaataaacctttttattttcacctcagaaaagtgagtgtactggcagttagtgtcactgctttgcacagtccccattaaaggaccctccagagagggacagtaactgtgcatgagaagccgctcccataagcctcctcagccagatgtcatgggtggaactggagctgtgtcggggccagcacagctgaactgtgacaatggcaggaggtggcatgtgcccagcacttccattaatctgagcctaggagttgaattctttggcaaggttggattctgaggtccttattatgttgaatgatggtgcaatactctcacctgcagtagaactgagttctgctgcagcttgtgtaaaagtgggcagtacacaagtacgtcccaaagcctgtgagcagtatacgtggatgctcacccatgagaaggagcacacacgcctcattctctgccctcacccactgctcacctagagcatcgctgagcgttagacaaagtgttacacagaatgattaaaactttcagacttctacctatgctctttagtcctgtaaattgggttgtattgatgtcaactctggtgccttagaagttagtagtttgggaacctatctgtaaaatcagatgttttttctttgtagagaaggatttctggtgcttttgcttactaagagaccgatattcttaagttgttttcttgttttaacagccttgagaaatgtttggttttggccagcagaattcttgtctacttttttctttcccaaaaagtgttttttaatttctctaccaaagaaaaaatgagcaggtttaggtttttacatgacttatatacattagataaaaggagctgtataatttagcaggaagggactatgggagaatactttactgtgagtggaaaatgttagcacatttgactggtttgccctggaatccactgcacctttacactgcaccatgaaacctacactccctggtatcatagcgcgtcatcacctcaacaagtcagtcgtctccattgatatttgtacaaaaggtatacatggggaacacgtgttcattcattaagtccatcttgcgtgcagctatatccctgattggttatttttcctttccttctgaggttctcatgtcattttcttcatcggatgtgactaaaatttttctggtgtcttctgccctctctttaattttgcctcttgaggggtagcagatgtgtcagtgcattttattacttgctgaaacattcaggcttacatttcttattagtttagtattttaaaagatttaattttctgaatgaggcatttgaattgtaccagcaatggacttttaaaaaattggatgtaaaaccattcagggtgatttttcttgtcagtggacagtgacgaacagagatttgaaatcccttacctccaataataagccattcagcctaaattcatttttatgaataaatctcttctttctcatggtaaatgtggcttgtgccactcaaacactagtgaaagggtatgtacaaccgcaacatcaggccaggacaccatttatttaaccaagtaatggaggagagtgaaacattttccaaggccttatttctttttcagaatgctttaagtgttgattatatgtgctgggtctctagagaagtttttatttgttacaatactgctgctttgagcaattttgtttctcttcattgtctgttagggaaatcaccagctttggcatcttaacaacaaacagtggatgggtaatttttatttctgatacgcatctttagagtcaaatatatcttttccctgtactcctcatgtacaaccaaagaacatacattatgaaaattgtattataatatctggaaacacaacattttcctctggcaggtgacttttgtacgaaatgaaaaaaaaaaaacctgtattttttttgttgttcttttgtgattaaggatatacatttagtagtctttgttattaaaggaacctgctgataagtacaagtgtgaccatctcattcaaatgtttgttgttatgatgcaaatggatattggtttcaatagaagctggatccttaatactgcattttctgaattctgttttaatatttgtgttaaagtagacatagctgaactcacatggaatcctggagttttgttatcagcagctttgcagtttgggaaacaaagaaaccaaagctgagtgttttaaagaatgaacatatctggaaatccttgctctcaaaacaaaacaatataatctatcaaaggtgttttactcagtgttctaatttttaaaaaattttatctgcatatttgcatcaaatatttatgtgtaaaatgtatgttttacctccttaaaatgcctaaaagttagttaatagttactttggtttaacctatacacaatgattaagtgcatttaatattggtaatttaatgaaaaccattccttgcccaatggatgtataaatttttgaaagaataagcagaattatataatatgaaatgctatgtaaagttttctatgtaaaaatattatgtataatactattaaaatatcccatgctttgatcaggtggtacatcaataaaattttaaaaagtaaaaaagttac

SEQ ID NO: 307732 - DNA, 5735 bp, Homo sapiens
tacaccctcctcggcctcccaaagtgctgagattacaggtgtgagccaccacacccggtctaatgtttattttgtctggaattatcttcctaggatttttactgggtctaccagactggatggaaatgcaatagttgactttgtccgctggctgtgtgctgtgtccatggatgaactggcttccccccaccatcctcgcatgttcagcttgcagaagattgtggagatatcatactacaacatgaatcggatccgactacagtggtctcgaatatggcatgtgattggagatcacttcaataaggttggctgcaaccctaatgaagatgtggctatctttgctgttgactcattaaggcaactctccatgaagtttcttgagaagggtgaattagccaacttccgtttccagaaagattttctgaggccctttgagcatattatgaagaaaaacaggtctcccaccatccgggacatggcgatccgctgcattgcccagatggtgaactcccaggcggccaacatccgctcaggttggaagaacatctttgccgtgttccaccaggcagcctctgatcatgatgggaacattgtggagctggccttccagaccacttgccacattgtcacaactattttccagcaccattttcctgcagccatcgattcctttcaggatgctgtgaagtgcttatcagagttcgcctgcaacgccgctttccctgacacgagcatggaagcgattcggctcatccgcttctgtggcaaatacgtctctgagaggcctcgggtgctacaagaatacacaagtgatgacatgaatgtagctcctggtgacagagtctgggtccgaggctggttccccatcttattcgaactctcctgcatcattaatagatgcaagttagatgtacgaacaaggggactcacagtcatgtttgagatcatgaagagctatggccacacctttgaaaagcactggtggcaggacctgttcagaatcgtgtttcggatttttgacaatatgaaactccctgagcaactgtcagagaaatctgagtggatgacaacaacctgcaatcacgcactttatgctatttgtgatgtttttacccagttttatgaagctttgaatgaagttcttctttctgatgtatttgcacaattgcagtggtgtgtcaaacaagataatgaacagttggcgcgatcaggtacaaattgcttagaaaacttagtaatatccaatggagagaaattcagtcctgaagtctgggatgaaacctgcaactgtatgttggatattttcaaaacaaccatcccacatgttttgctgacatggagacctgtaggaatggaggaagattcatcagaaaagcatttggatgtggatctggaccgccagtctttaagcagcatagataaaaatccctctgagaggggacagagccagctctctaacccaacagatgacagctggaagggtagaccatacgcaaatcagaaactgtttgccagcctcctcatcaagtgtgtggtccagttggaattgatacagaccattgacaacattgtgttctaccctgcgacgagcaaaaaggaggatgcagagcacatggttgccgcccagcaagacacgctggatgcagatatccacatagagacggaggatcagggcatgtataagtacatgtcttcccagcacctcttcaagctgttggactgtttgcaggaatcccattcattctcaaaggccttcaactccaattacgagcagcggactgtcctgtggcgagcaggttttaagggcaagtctaaacccaatcttctaaaacaagaaaccagcagcctggcctgttgtttgaggatcctgtttcgaatgtatgttgatgagaaccgcagggattcctgggaagaaatacagcagagacttttaactgtttgcagtgaagctcttgcctatttcatcactgtgaattctgagagccatcgggaggcctggacaagtctcttgttgttacttctaactaaaaccctcaaaataaatgatgaaaagttcaaagcacatgcttcaatgtactacccctacttgtgtgaaattatgcagtttgacctgatccctgagctccgagcagttctgcggaagttcttcctacggataggtgttgtgtataagatatggataccagaagagccatcacaggtaccagcagcactgtcaccagtgtggtagccctggctgcccaggccagtgctgcagctctgcagaatgttcagcatgccatttctgactggcacatctcgtgaagtttcatagaaacaaggagttggcatcttggatctcagaatggcctggaaacggatggcctctacgctgttccatcacagtctccaactaaggcttatggtatttcattaaactgttgcatacccagttagcacagtaggtggggagtctgcttcatttctatcattccatttttctgattaaactgtcaaatctgtcattgcatatgccatcgttttctagcaaaatcccatgattggctataaacgttttgtaagaagtcactctccttgaaaatactgaacatagctgtataggtttgtgattattagagaatatgttaataaaacttcttgtaacggctaactgccacctaaaatatgctgggttttctgttgtttgagtgtgttagagaaatttgaatgtttttgtcagttacgagtcagccgtaattagattagtttaaggacaggtcaggattagagaagagttgtttttgtgttttgttaatgtctgagtgatttttaaagtattttacaaaaagatattgaaaatttggttgaaggcagagtttagtaattaagttagaattaagagttttgcgaggttaaaaaaatgtgcctcgtggatctccctgttttagtaacatggagagaaaaagtctacacgaaaaagtgaacaatttaatgaagatgattagccttccttgaaataagtatttgtggatgggtgttaaattaaaatttccagaatacactgtccatctcacacactctgaaatctaatatatgaagtagtaatgaaaatgaagtagtaatttaaccagagttcatttatccttgaataaacctttttattttcacctcagaaaagtgagtgtactggcagttagtgtcactgctttgcacagtccccattaaaggaccctccagagagggacagtaactgtgcatgagaagccgctcccataagcctcctcagccagatgtcatgggtggaactggagctgtgtcggggccagcacagctgaactgtgacaatggcaggaggtggcatgtgcccagcacttccattaatctgagcctaggagttgaattctttggcaaggttggattctgaggtccttattatgttgaatgatggtgcaatactctcacctgcagtagaactgagttctgctgcagcttgtgtaaaagtgggcagtacacaagtacgtcccaaagcctgtgagcagtatacgtggatgctcacccatgagaaggagcacacacgcctcattctctgccctcacccactgctcacctagagcatcgctgagcgttagacaaagtgttacacagaatgattaaaactttcagacttctacctatgctctttagtcctgtaaattgggttgtattgatgtcaactctggtgccttagaagttagtagtttgggaacctatctgtaaaatcagatgttttttctttgtagagaaggatttctggtgcttttgcttactaagagaccgatattcttaagttgttttcttgttttaacagccttgagaaatgtttggttttggccagcagaattcttgtctacttttttctttcccaaaaagtgttttttaatttctctaccaaagaaaaaatgagcaggtttaggtttttacatgacttatatacattagataaaaggagctgtataatttagcaggaagggactatgggagaatactttactgtgagtggaaaatgttagcacatttgactggtttgccctggaatccactgcacctttacactgcaccatgaaacctacactccctggtatcatagcgcgtcatcacctcaacaagtcagtcgtctccattgatatttgtacaaaaggtatacatggggaacacgtgttcattcattaagtccatcttgcgtgcagctatatccctgattggttatttttcctttccttctgaggttctcatgtcattttcttcatcggatgtgactaaaatttttctggtgtcttctgccctctctttaattttgcctcttgaggggtagcagatgtgtcagtgcattttattacttgctgaaacattcaggcttacatttcttattagtttagtattttaaaagatttaattttctgaatgaggcatttgaattgtaccagcaatggacttttaaaaaattggatgtaaaaccattcagggtgatttttcttgtcagtggacagtgacgaacagagatttgaaatcccttacctccaataataagccattcagcctaaattcatttttatgaataaatctcttctttctcatggtaaatgtggcttgtgccactcaaacactagtgaaagggtatgtacaaccgcaacatcaggccaggacaccatttatttaaccaagtaatggaggagagtgaaacattttccaaggccttatttctttttcagaatgctttaagtgttgattatatgtgctgggtctctagagaagtttttatttgttacaatactgctgctttgagcaattttgtttctcttcattgtctgttagggaaatcaccagctttggcatcttaacaacaaacagtggatgggtaatttttatttctgatacgcatctttagagtcaaatatatcttttccctgtactcctcatgtacaaccaaagaacatacattatgaaaattgtattataatatctggaaacacaacattttcctctggcaggtgacttttgtacgaaatgaaaaaaaaaaaacctgtattttttttgttgttcttttgtgattaaggatatacatttagtagtctttgttattaaaggaacctgctgataagtacaagtgtgaccatctcattcaaatgtttgttgttatgatgcaaatggatattggtttcaatagaagctggatccttaatactgcattttctgaattctgttttaatatttgtgttaaagtagacatagctgaactcacatggaatcctggagttttgttatcagcagctttgcagtttgggaaacaaagaaaccaaagctgagtgttttaaagaatgaacatatctggaaatccttgctctcaaaacaaaacaatataatctatcaaaggtgttttactcagtgttctaatttttaaaaaattttatctgcatatttgcatcaaatatttatgtgtaaaatgtatgttttacctccttaaaatgcctaaaagttagttaatagttactttggtttaacctatacacaatgattaagtgcatttaatattggtaatttaatgaaaaccattccttgcccaatggatgtataaatttttgaaagaataagcagaattatataatatgaaatgctatgtaaagttttctatgtaaaaatattatgtataatactattaaaatatcccatgctttgatcaggtggtacatcaataaaattttaaaaagtaaaaaagttac

SEQ ID NO: 307733 - DNA, 4651 bp, Homo sapiens
acttgctcgcataaaaaatttgtcacacttattgttaaatcctaatatgtagagaaatgtcctctgggttggaataggaaaatagggaattttaatgggaggagaagtaatttaaattcttaatctctccattgcagcctgtgaggcatgctacattaagcatgtagtatcattttattttgagctaagcaaggcacttaaatacaggctggaccagccgtgttaaaacaggcacatctctgcccaaattatcatgaagaaaagtgagcattgtgtttccctctggtttacatttaggatgtggatctggaccgccagtctttaagcagcatagataaaaatccctctgagaggggacagagccagctctctaacccaacagatgacagctggaagggtagaccatacgcaaatcagaaactgtttgccagcctcctcatcaagtgtgtggtccagttggaattgatacagaccattgacaacattgtgttctaccctgcgacgagcaaaaaggaggatgcagagcacatggttgccgcccagcaagacacgctggatgcagatatccacatagagacggaggatcagggcatgtataagtacatgtcttcccagcacctcttcaagctgttggactgtttgcaggaatcccattcattctcaaaggccttcaactccaattacgagcagcggactgtcctgtggcgagcaggttttaagggcaagtctaaacccaatcttctaaaacaagaaaccagcagcctggcctgttgtttgaggatcctgtttcgaatgtatgttgatgagaaccgcagggattcctgggaagaaatacagcagagacttttaactgtttgcagtgaagctcttgcctatttcatcactgtgaattctgagagccatcgggaggcctggacaagtctcttgttgttacttctaactaaaaccctcaaaataaatgatgaaaagttcaaagcacatgcttcaatgtactacccctacttgtgtgaaattatgcagtttgacctgatccctgagctccgagcagttctgcggaagttcttcctacggataggtgttgtgtataagatatggataccagaagagccatcacaggtaccagcagcactgtcaccagtgtggtagccctggctgcccaggccagtgctgcagctctgcagaatgttcagcatgccatttctgactggcacatctcgtgaagtttcatagaaacaaggagttggcatcttggatctcagaatggcctggaaacggatggcctctacgctgttccatcacagtctccaactaaggcttatggtatttcattaaactgttgcatacccagttagcacagtaggtggggagtctgcttcatttctatcattccatttttctgattaaactgtcaaatctgtcattgcatatgccatcgttttctagcaaaatcccatgattggctataaacgttttgtaagaagtcactctccttgaaaatactgaacatagctgtataggtttgtgattattagagaatatgttaataaaacttcttgtaacggctaactgccacctaaaatatgctgggttttctgttgtttgagtgtgttagagaaatttgaatgtttttgtcagttacgagtcagccgtaattagattagtttaaggacaggtcaggattagagaagagttgtttttgtgttttgttaatgtctgagtgatttttaaagtattttacaaaaagatattgaaaatttggttgaaggcagagtttagtaattaagttagaattaagagttttgcgaggttaaaaaaatgtgcctcgtggatctccctgttttagtaacatggagagaaaaagtctacacgaaaaagtgaacaatttaatgaagatgattagccttccttgaaataagtatttgtggatgggtgttaaattaaaatttccagaatacactgtccatctcacacactctgaaatctaatatatgaagtagtaatgaaaatgaagtagtaatttaaccagagttcatttatccttgaataaacctttttattttcacctcagaaaagtgagtgtactggcagttagtgtcactgctttgcacagtccccattaaaggaccctccagagagggacagtaactgtgcatgagaagccgctcccataagcctcctcagccagatgtcatgggtggaactggagctgtgtcggggccagcacagctgaactgtgacaatggcaggaggtggcatgtgcccagcacttccattaatctgagcctaggagttgaattctttggcaaggttggattctgaggtccttattatgttgaatgatggtgcaatactctcacctgcagtagaactgagttctgctgcagcttgtgtaaaagtgggcagtacacaagtacgtcccaaagcctgtgagcagtatacgtggatgctcacccatgagaaggagcacacacgcctcattctctgccctcacccactgctcacctagagcatcgctgagcgttagacaaagtgttacacagaatgattaaaactttcagacttctacctatgctctttagtcctgtaaattgggttgtattgatgtcaactctggtgccttagaagttagtagtttgggaacctatctgtaaaatcagatgttttttctttgtagagaaggatttctggtgcttttgcttactaagagaccgatattcttaagttgttttcttgttttaacagccttgagaaatgtttggttttggccagcagaattcttgtctacttttttctttcccaaaaagtgttttttaatttctctaccaaagaaaaaatgagcaggtttaggtttttacatgacttatatacattagataaaaggagctgtataatttagcaggaagggactatgggagaatactttactgtgagtggaaaatgttagcacatttgactggtttgccctggaatccactgcacctttacactgcaccatgaaacctacactccctggtatcatagcgcgtcatcacctcaacaagtcagtcgtctccattgatatttgtacaaaaggtatacatggggaacacgtgttcattcattaagtccatcttgcgtgcagctatatccctgattggttatttttcctttccttctgaggttctcatgtcattttcttcatcggatgtgactaaaatttttctggtgtcttctgccctctctttaattttgcctcttgaggggtagcagatgtgtcagtgcattttattacttgctgaaacattcaggcttacatttcttattagtttagtattttaaaagatttaattttctgaatgaggcatttgaattgtaccagcaatggacttttaaaaaattggatgtaaaaccattcagggtgatttttcttgtcagtggacagtgacgaacagagatttgaaatcccttacctccaataataagccattcagcctaaattcatttttatgaataaatctcttctttctcatggtaaatgtggcttgtgccactcaaacactagtgaaagggtatgtacaaccgcaacatcaggccaggacaccatttatttaaccaagtaatggaggagagtgaaacattttccaaggccttatttctttttcagaatgctttaagtgttgattatatgtgctgggtctctagagaagtttttatttgttacaatactgctgctttgagcaattttgtttctcttcattgtctgttagggaaatcaccagctttggcatcttaacaacaaacagtggatgggtaatttttatttctgatacgcatctttagagtcaaatatatcttttccctgtactcctcatgtacaaccaaagaacatacattatgaaaattgtattataatatctggaaacacaacattttcctctggcaggtgacttttgtacgaaatgaaaaaaaaaaaacctgtattttttttgttgttcttttgtgattaaggatatacatttagtagtctttgttattaaaggaacctgctgataagtacaagtgtgaccatctcattcaaatgtttgttgttatgatgcaaatggatattggtttcaatagaagctggatccttaatactgcattttctgaattctgttttaatatttgtgttaaagtagacatagctgaactcacatggaatcctggagttttgttatcagcagctttgcagtttgggaaacaaagaaaccaaagctgagtgttttaaagaatgaacatatctggaaatccttgctctcaaaacaaaacaatataatctatcaaaggtgttttactcagtgttctaatttttaaaaaattttatctgcatatttgcatcaaatatttatgtgtaaaatgtatgttttacctccttaaaatgcctaaaagttagttaatagttactttggtttaacctatacacaatgattaagtgcatttaatattggtaatttaatgaaaaccattccttgcccaatggatgtataaatttttgaaagaataagcagaattatataatatgaaatgctatgtaaagttttctatgtaaaaatattatgtataatactattaaaatatcccatgctttgatcaggtggtacatcaataaaattttaaaaagtaaaaaagttac

SEQ ID NO: 307734 - DNA, 4255 bp, Homo sapiens
ttatcatctaacatagatcagaaactgtttgccagcctcctcatcaagtgtgtggtccagttggaattgatacagaccattgacaacattgtgttctaccctgcgacgagcaaaaaggaggatgcagagcacatggttgccgcccagcaagacacgctggatgcagatatccacatagagacggaggatcagggcatgtataagtacatgtcttcccagcacctcttcaagctgttggactgtttgcaggaatcccattcattctcaaaggccttcaactccaattacgagcagcggactgtcctgtggcgagcaggttttaagggcaagtctaaacccaatcttctaaaacaagaaaccagcagcctggcctgttgtttgaggatcctgtttcgaatgtatgttgatgagaaccgcagggattcctgggaagaaatacagcagagacttttaactgtttgcagtgaagctcttgcctatttcatcactgtgaattctgagagccatcgggaggcctggacaagtctcttgttgttacttctaactaaaaccctcaaaataaatgatgaaaagttcaaagcacatgcttcaatgtactacccctacttgtgtgaaattatgcagtttgacctgatccctgagctccgagcagttctgcggaagttcttcctacggataggtgttgtgtataagatatggataccagaagagccatcacaggtaccagcagcactgtcaccagtgtggtagccctggctgcccaggccagtgctgcagctctgcagaatgttcagcatgccatttctgactggcacatctcgtgaagtttcatagaaacaaggagttggcatcttggatctcagaatggcctggaaacggatggcctctacgctgttccatcacagtctccaactaaggcttatggtatttcattaaactgttgcatacccagttagcacagtaggtggggagtctgcttcatttctatcattccatttttctgattaaactgtcaaatctgtcattgcatatgccatcgttttctagcaaaatcccatgattggctataaacgttttgtaagaagtcactctccttgaaaatactgaacatagctgtataggtttgtgattattagagaatatgttaataaaacttcttgtaacggctaactgccacctaaaatatgctgggttttctgttgtttgagtgtgttagagaaatttgaatgtttttgtcagttacgagtcagccgtaattagattagtttaaggacaggtcaggattagagaagagttgtttttgtgttttgttaatgtctgagtgatttttaaagtattttacaaaaagatattgaaaatttggttgaaggcagagtttagtaattaagttagaattaagagttttgcgaggttaaaaaaatgtgcctcgtggatctccctgttttagtaacatggagagaaaaagtctacacgaaaaagtgaacaatttaatgaagatgattagccttccttgaaataagtatttgtggatgggtgttaaattaaaatttccagaatacactgtccatctcacacactctgaaatctaatatatgaagtagtaatgaaaatgaagtagtaatttaaccagagttcatttatccttgaataaacctttttattttcacctcagaaaagtgagtgtactggcagttagtgtcactgctttgcacagtccccattaaaggaccctccagagagggacagtaactgtgcatgagaagccgctcccataagcctcctcagccagatgtcatgggtggaactggagctgtgtcggggccagcacagctgaactgtgacaatggcaggaggtggcatgtgcccagcacttccattaatctgagcctaggagttgaattctttggcaaggttggattctgaggtccttattatgttgaatgatggtgcaatactctcacctgcagtagaactgagttctgctgcagcttgtgtaaaagtgggcagtacacaagtacgtcccaaagcctgtgagcagtatacgtggatgctcacccatgagaaggagcacacacgcctcattctctgccctcacccactgctcacctagagcatcgctgagcgttagacaaagtgttacacagaatgattaaaactttcagacttctacctatgctctttagtcctgtaaattgggttgtattgatgtcaactctggtgccttagaagttagtagtttgggaacctatctgtaaaatcagatgttttttctttgtagagaaggatttctggtgcttttgcttactaagagaccgatattcttaagttgttttcttgttttaacagccttgagaaatgtttggttttggccagcagaattcttgtctacttttttctttcccaaaaagtgttttttaatttctctaccaaagaaaaaatgagcaggtttaggtttttacatgacttatatacattagataaaaggagctgtataatttagcaggaagggactatgggagaatactttactgtgagtggaaaatgttagcacatttgactggtttgccctggaatccactgcacctttacactgcaccatgaaacctacactccctggtatcatagcgcgtcatcacctcaacaagtcagtcgtctccattgatatttgtacaaaaggtatacatggggaacacgtgttcattcattaagtccatcttgcgtgcagctatatccctgattggttatttttcctttccttctgaggttctcatgtcattttcttcatcggatgtgactaaaatttttctggtgtcttctgccctctctttaattttgcctcttgaggggtagcagatgtgtcagtgcattttattacttgctgaaacattcaggcttacatttcttattagtttagtattttaaaagatttaattttctgaatgaggcatttgaattgtaccagcaatggacttttaaaaaattggatgtaaaaccattcagggtgatttttcttgtcagtggacagtgacgaacagagatttgaaatcccttacctccaataataagccattcagcctaaattcatttttatgaataaatctcttctttctcatggtaaatgtggcttgtgccactcaaacactagtgaaagggtatgtacaaccgcaacatcaggccaggacaccatttatttaaccaagtaatggaggagagtgaaacattttccaaggccttatttctttttcagaatgctttaagtgttgattatatgtgctgggtctctagagaagtttttatttgttacaatactgctgctttgagcaattttgtttctcttcattgtctgttagggaaatcaccagctttggcatcttaacaacaaacagtggatgggtaatttttatttctgatacgcatctttagagtcaaatatatcttttccctgtactcctcatgtacaaccaaagaacatacattatgaaaattgtattataatatctggaaacacaacattttcctctggcaggtgacttttgtacgaaatgaaaaaaaaaaaacctgtattttttttgttgttcttttgtgattaaggatatacatttagtagtctttgttattaaaggaacctgctgataagtacaagtgtgaccatctcattcaaatgtttgttgttatgatgcaaatggatattggtttcaatagaagctggatccttaatactgcattttctgaattctgttttaatatttgtgttaaagtagacatagctgaactcacatggaatcctggagttttgttatcagcagctttgcagtttgggaaacaaagaaaccaaagctgagtgttttaaagaatgaacatatctggaaatccttgctctcaaaacaaaacaatataatctatcaaaggtgttttactcagtgttctaatttttaaaaaattttatctgcatatttgcatcaaatatttatgtgtaaaatgtatgttttacctccttaaaatgcctaaaagttagttaatagttactttggtttaacctatacacaatgattaagtgcatttaatattggtaatttaatgaaaaccattccttgcccaatggatgtataaatttttgaaagaataagcagaattatataatatgaaatgctatgtaaagttttctatgtaaaaatattatgtataatactattaaaatatcccatgctttgatcaggtggtacatcaataaaattttaaaaagtaaaaaagttac

SEQ ID NO: 307735 - DNA, 606 bp, Homo sapiens
  misc_feature (38)..(38): n is a, c, g, or t
atagtacagtatacgaagtcgagccggtaccccagttntagaagtttcaatagaagctggatccttaatactgcattttctgaattctgttttaatatttgtgttaaagtagacatagctgaactcacatggaatcctggagttttgttatcagcagctttgcagtttgggaaacaaagaaaccaaagctgagtgttttaaagaatgaacatatctggaaatccttgctctcaaaacaaaacaatataatctatcaaaggtgttttactcagtgttctaatttttaaaaaattttatctgcatatttgcatcaaatatttatgtgtaaaatgtatgttttacctccttaaaatgcctaaaagttagttaatagttactttggtttaacctatacacaatgattaagtgcatttaatattggtaatttaatgaaaaccattccttgcccaatggatgtataaatttttgaaagaataagcagaattatataatatgaaatgctatgtaaagttttctatgtaaaaatattatgtataatactattaaaatatcccatgctttgatcaggtggtacatcaataaaattttaaaaagtaaaaaagttac

SEQ ID NO: 307736 - DNA, 4902 bp, Homo sapiens
atgcaggagagccagaccaagagcatgttcgtgtcccgggccctggagaagatcctagccgacaaggaggtgaagcggccccagcactcccagctgcgcagggcctgccaggtggcgctcgatgaaattaaagcagaaatagaaaagcagaggcttggcactgctgcaccaccaaaggcaaacttcattgaagctgacaagtattttcttccattcgagctagcttgccagtccaagtccccaagggtagtcagcacatcccttgactgcttgcagaaactcatcgcatacgggcacatcactggcaacgcccctgacagtggagcccctgggaagcggctgatcgacagaattgttgaaaccatttgcagttgttttcagggccctcagactgatgaaggggttcagttacaaataattaaggctcttctgactgcagtgacttccccacacattgaaattcatgagggtactatcctgcagacagtgagaacatgttacaatatctatttggccagcaaaaatctcatcaatcaaaccactgccaaggctacccttactcagatgctgaacgtcattttcacccgcatggaaaaccaagtgttgcaggaggccagagaactggaaaaaccaatccagtcaaaaccccagtcccctgtgatccaagctgcagcagtatccccaaagttcgttcgtttgaagcacagtcaggcacaaagcaaaccaacaactcccgaaaaaacagatttaaccaacggtgaacatgccaggagtgattctggaaaagtaagcacagaaaatggagacgcacccagagaaagaggctcatcactgtcagggactgatgacggagcccaggaggtggtgaaggacatcttggaagatgtagtcacatctgccattaaagaagcagcggaaaagcatggtctgacagaacctgagagagttctaggtgaactggagtgccaggaatgtgctattcccccaggagttgatgaaaactcacagaccaacgggatagccgatgacaggcagtccttgtcgtcagcagataatctggaatcggatgcacaaggacatcaagtggctgccaggttctcccacgttctgcagaaggatgccttccttgtgttccgctccctgtgcaagctgtccatgaaaccccttggtgaaggccctccagacccaaaatcccatgagctgcgttccaaggtggtttccctgcagctgctcctctctgtgttgcaaaatgctggccccgtattcaggactcacgagatgttcatcaatgcaatcaagcaatatctctgtgtggccttgtccaaaaacggcgtctcttcagtgcctgatgtctttgagctctctcttgccatttttcttactcttctttcaaactttaaaatgcacttgaaaatgcagatagaggtctttttcaaagagattttcctgaacattttagaaacatcaacaagttcttttgagcacaggtggatggtcattcagactctgacgaggatctgtgcagatgcccagtgtgttgtggatatttatgtcaactacgactgtgatttaaatgctgctaacatttttgagcgccttgtaaatgatttatccaaaattgctcagggaagaagtggacatgagctgggaatgacacctctgcaggagctcagcctgaggaagaaaggcctggagtgcctcgtgtccattctcaagtgcatggtggagtggagcaaagacctgtatgtgaatcccaaccaccagaccagcctcggtcaggagaggctcacggatcaggaaataggggatgggaaaggccttgacatggcaagacggtgtagtgtgacgtccatggagtccacagtgtcctcggggacccagacaactgttcaggatgaccctgagcaatttgaggtcatcaagcaacaaaaagaaatcattgaacacggcatcgagctgttcaacaagaaacccaagagggggatccagtttctccaggagcagggcatgctgggaacgtcagttgaagacatagcccaattcctgcaccaggaggagcgcctggattccacccaagtaggcgattttctgggagatagcgcaaggttcaacaaggaggtgatgtatgcctacgtggaccaacttgacttctgtgaaaaagaatttgtctcagccctgcggacattcctagaaggtttccgcctacctggagaagcccaaaagattgaccgattaatggagaagtttgccgcaagatacatagaatgcaaccaagggcaaactctgtttgctagtgctgacactgcttatgtcctagcgtattcaattattatgctgactacagacttgcacagtcctcaggtaaaaaataaaatgacgaaagagcagtatattaaaatgaatcggggtatcaatgatagtaaagatctgccagaagagtatctctcaagcatctatgaagagatagaaggcaagaaaattgcaatgaaagaaacaaaagagctaacgattgcaaccaaatctactaagcagaatgtagctagtgaaaagcagcggcggctgctgtacaacttagagatggagcaaatggctaaaacagccaaagctctgatggaggctgtgagccatgccaaagccccgtttaccagtgccactcacctggaccatgtccggccaatgttcaaactggtgtggacgccactattggcagcctacagcatcggactccagaactgtgatgacactgaagtggcctccttgtgtttggaaggcatccgatgtgcaatccgaatcgcctgcatctttggaatgcagctggaacgagatgcctatgttcaggctcttgctcgcttctccctactcacagccagctccagcatcacaaaaatgaagcagaaaaacatcgacaccattaagacgcttatcacagtggctcacaccgatggcaactaccttgggaattcctggcatgagatcttgaaatgcatcagccagctggagctcgctcagctgataggaaccggtgtgaagacgcgctacctgtctggatctgggcgtgaaagagaagggagcctgaagggccacacattggcaggagaagagttcatgggccttggcctcggtaatttggtgagtggcggagtggataaaagacagatggccagcttccaagaatcggttggtgagaccagctcgcagagtgtggttgtagctgtggacaggatttttactgggtctaccagactggatggaaatgcaatagttgactttgtccgctggctgtgtgctgtgtccatggatgaactggcttccccccaccatcctcgcatgttcagcttgcagaagattgtggagatatcatactacaacatgaatcggatccgactacagtggtctcgaatatggcatgtgattggagatcacttcaataaggttggctgcaaccctaatgaagatgtggctatctttgctgttgactcattaaggcaactctccatgaagtttcttgagaagggtgaattagccaacttccgtttccagaaagattttctgaggccctttgagcatattatgaagaaaaacaggtctcccaccatccgggacatggcgatccgctgcattgcccagatggtgaactcccaggcggccaacatccgctcaggttggaagaacatctttgccgtgttccaccaggcagcctctgatcatgatgggaacattgtggagctggccttccagaccacttgccacattgtcacaactattttccagcaccattttcctgcagccatcgattcctttcaggatgctgtgaagtgcttatcagagttcgcctgcaacgccgctttccctgacacgagcatggaagcgattcggctcatccgcttctgtggcaaatacgtctctgagaggcctcgggtgctacaagaatacacaagtgatgacatgaatgtagctcctggtgacagagtctgggtccgaggctggttccccatcttattcgaactctcctgcatcattaatagatgcaagttagatgtacgaacaaggggactcacagtcatgtttgagatcatgaagagctatggccacacctttgaaaagcactggtggcaggacctgttcagaatcgtgtttcggatttttgacaatatgaaactccctgagcaactgtcagagaaatctgagtggatgacaacaacctgcaatcacgcactttatgctatttgtgatgtttttacccagttttatgaagctttgaatgaagttcttctttctgatgtatttgcacaattgcagtggtgtgtcaaacaagataatgaacagttggcgcgatcaggtacaaattgcttagaaaacttagtaatatccaatggagagaaattcagtcctgaagtctgggatgaaacctgcaactgtatgttggatattttcaaaacaaccatcccacatgttttgctgacatggagacctgtaggaatggaggaagattcatcagaaaagcatttggatgtggatctggaccgccagtctttaagcagcatagataaaaatccctctgagaggggacagagccagctctctaacccaacagatgacagctggaagggtagaccatacgcaacctcctcatcaagtgtgtggtccagttggaattgatacagaccattgacaacattgtgttctaccctgcgacgagcaaaaaggaggatgcagagcacatggttgccgcccagcaagacacgctggatgcagatatccacatagagacggaggatcagggcatgtataagtacatgtcttcccagcacctcttcaagctgttgtaactggagctgttgtaatggagctgttgtaactgggctgttgtaactggagctgttaaccggagctgtttaactg

SEQ ID NO: 307737 - DNA, 1468 bp, Homo sapiens
atgcaggagagccagaccaagagcatgttcgtgtcccgggccctggagaagatcctagccgacaaggaggtgaagcggccccagcactcccagctgcgcagggcctgccaggtggcgctcgatgaaattaaagcagaaatagaaaagcagaggcttggcactgctgcaccaccaaaggcaaacttcattgaagctgacaagtattttcttccattcgagctagcttgccagtccaagtccccaagggtagtcagcacatcccttgactgcttgcagaaactcatcgcatacgggcacatcactggcaacgcccctgacagtggagcccctgggaagcggctgatcgacagaattgttgaaaccatttgcagttgttttcagggccctcagactgatgaaggggttcagttacaaataattaaggctcttctgactgcagtgacttccccacacattgaaattcatgagggtactatcctgcagacagtgagaacatgttacaatatctatttggccagcaaaaatctcatcaatcaaaccactgccaaggctacccttactcagatgctgaacgtcattttcacccgcatggaaaaccaagtgttgcaggaggccagagaactggaaaaaccaatccagtcaaaaccccagtcccctgtgatccaagctgcagcagtatccccaaagttcgttcgtttgaagcacagtcaggcacaaagcaaaccaacaactcccgaaaaaacagatttaaccaacggtgaacatgccaggagtgattctggaaaagtaagcacagaaaatggagacgcacccagagaaagaggctcatcactgtcaggtacgggctgatacggtatggctctttttccaagtgtgagagggaatcagcctgtgaggggcagaagaagtgtatgtcataacatctgaaggaaacctctgataacagcttatctctttctgggcctttccctttgcttttctcttagggaacacaaccagtgaggcatgatgtcaagtgtcccgttgtcagctgtgctgttttctctaaatagtactgggatgtatctagctgctacttcttcatgtcagcctcagtgcaacaggttcaggttgggacacttatctttcagtagttaattgattgggtgattagtcactcagtgtccacaggaggacaagggcttagattctcatgtctacactggatctccatgccttgcccagtgcctagcagtagccactcatagatatccatggaaggagccagaaggtagcaggtggatggacggatagacagatggacagatagctttgttttcttcttctggtgaccatgtacatcacttgtttttgttgggtttttaagtgagagactaacccacacctgattatattcttaaagtaaatgaaatgaaatactggattgagttgttataagatgatacttctgactgttcatatctctccc

SEQ ID NO: 307738 - DNA, 1480 bp, Homo sapiens
atgcaggagagccagaccaagagcatgttcgtgtcccgggccctggagaagatcctagccgacaaggaggtgaagcggccccagcactcccagctgcgcagggcctgccaggtggcgctcgatgaaattaaagcagaaatagaaaagcagaggcttggcactgctgcaccaccaaaggcaaacttcattgaagctgacaagtattttcttccattcgagctagcttgccagtccaagtccccaagggtagtcagcacatcccttgactgcttgcagaaactcatcgcatacgggcacatcactggcaacgcccctgacagtggagcccctgggaagcggctgatcgacagaattgttgaaaccatttgcagttgttttcagggccctcagactgatgaaggggttcagttacaaataattaaggctcttctgactgcagtgacttccccacacattgaaattcatgagggtactatcctgcagacagtgagaacatgttacaatatctatttggccagcaaaaatctcatcaatcaaaccactgccaaggctacccttactcagatgctgaacgtcattttcacccgcatggaaaaccaagtgttgcaggaggccagagaactggaaaaaccaatccagtcaaaaccccagtcccctgtgatccaagctgcagcagtatccccaaagttcgttcgtttgaagcacagtcaggcacaaagcaaaccaacaactcccgaaaaaacagatttaaccaacggtgaacatgccaggagtgattctggaaaagtaagcacagaaaatggagacgcacccagagaaagaggctcatcactgtcagggactgatgacggagcccaggaggtggtgaaggacatcttggaagatgtagtcacatctgccattaaagaagcagcggaaaagcatggtctgacagaacctgagagagttctaggtgaactggagtgccaggaatgtgctattcccccaggagttgatgaaaactcacagaccaacgggatagccgatgacaggcagtccttgtcgtcagcagataatctggaatcggatgcacaaggacatcaagtggctgccaggttctcccacgttctgcagaaggatgccttccttgtgttccgctccctgtgcaagctgtccatgaaaccccttggtgaaggccctccagacccaaagtaagcagacagcagttcttggccaccttcagtccaatgatccagcagcacatggtactgtgtttcacacttcccttgttccaagaagtttcagtgtcatgtctctttgtcagtgtaagtgcaggaacggttttacaacttttcagactcatgcagtctctagagtcctttcatatggaattgtctctgtatccccaccaaccaagattttgcccagttttgcttttcttggcatatgaatgctaaaaaagtctgtttattgaacacataaaaaacacatttttactagc

SEQ ID NO: 307739 - DNA, 719 bp, Homo sapiens
gtatttccacctggggacactcatccactggacttctgatgctttaatttgccacagctcagattaagacttctaacccctccttttagagttttaaaggattggcaataaaaggctaattctaacctagtcctgccccacctctccttttttagaggatgaccaacttaggctggtttgccaaggacttcctggttttagcactaaaagtctcatgtcccagaaaccccctaatctcgtcaaactgggacacttggttacgttacctacaagctgagtactgttaatcacaggacctaagatactggtgctgccaatttttgattgggtgctacggtaaatgtggatttaccttacactatacaattgtgtggcctcaaagtaagcatcctgcttgtctggcatcaaatgtaattttgtaagagtgacacaactttaagaggtgggtcaggcaattgttaaccccttccttgatgagaaaattgaggcttggatgggtggaatgaactgcctgagatttcaatttgctcagaagcaggcctaaaaacaacctcctgtcttccagcttcctagtacttccaacatgtgtttcctgagtgagatgtggccaccggagtctgtagttcactggggaaatttgttggcaaacatcttgtttgataagaaaacctaactgctatttgatcagaatttctgatacttgtatgttattttccaag

SEQ ID NO: 307740 - DNA, 480 bp, Homo sapiens
aggtgctattaattctttaaaattctactcattggtaaaggagcaaggccttctcaagaaacatactgtttgacattttttcttttagcactgttgtggtttttcattttctttgccagatcccatgagctgcgttccaaggtggtttccctgcagctgctcctctctgtgttgcaaaatgctggccccgtattcaggactcacgagatgttcatcaatgcaatcaagcaatatctctgtgtggccttgtccaaaaacggcgtctcttcagtgcctgatgtctttgagctctctcttgccatttttcttactcttctttcaaactttaaaatgcacttgaaaatgcagatagaggtacggattccaaagttttttcatttcattatttactattattattagtcattaattataatactcaatattgagaatgctgctaatattacactaagcattaggaaaatggttcatgaaaatgtt

SEQ ID NO: 307741 - DNA, 275 bp, Homo sapiens
tttaactcttcaaaaaaattttaataaaaattttaatactgtctgtagcatggcttcattaattaaaagcctagaaactcaccagttgctgtctccaactcacaatatacagtatttgagacctggttggcatcaaaatagcagtagaagtttaatgatagatactgctttattttacagataatgaacagttggcgcgatcaggtacaaattgcttagaaaacttagtaatatccaatggagagaaattcagtcctgaagtctgggatgaaacc

SEQ ID NO: 307742 - DNA, 348 bp, Homo sapiens
gatttttactgggtctaccagactggatggaaatgcaataggtatgtatttgacttacctgtgaaaactgcagaagcctcacgctgtgaccgtctgactgttcctaacgaggctttgcttgtgttgttgggtctggcctgtagttgactttgtccgctggctgtgtgctgtgtccatggatgaactggcttccccccaccatcctcgcatgttcagcttgcagaagattgtggagatatcatactacaacatgaatcggatccgactacagtggtctcgaatatggcatgtgattggagatcacttcaataaggtaactcttcaaatttaaaaaccattcctgttaaa

SEQ ID NO: 307743 - DNA, 511 bp, Homo sapiens
cagacttcccacctgagtcagctttgtttaagggtccttcctagaagtacccacaccacttctgctcatatctcactggctagaagtttatcacatggccatcctttatttaagggaggcagggaaatgttctttttattccacatggcagtgtgtccagctaacacgtagggttctattagtgttggagaaggggagagtggatatgaggtgacaatcagcagactctgaccaggtatagctgggtcagaaattgaaggtggaatttagaaaagctgccaggacagacatgaccttgctagcttatacgtgatggcatgttcatagtattctattattatttatctcaaataccagcttttgctatcctccagattttgaaataagcaacttgtgtcccatctctgcttgaaacaggttcaacaagaaacccaagagggggatccagtttctccaggagcagggcatgctgggaacgtcagttgaagacatagcccaattcctgcaccag

SEQ ID NO: 307744 - DNA, 202 bp, Homo sapiens
atcacaatgcccagagcattccatcttcttcattagctcttctatcctctgtcctgtcctctagcaagacacgctggatgcagatatccacatagagacggaggatcagggcatgtataagtacatgtcttcccagcacctcttcaagctgttggactgtttgcaggaatcccattcattctcaaaggccttcaactccaat

SEQ ID NO: 307745 - DNA, 936 bp, Homo sapiens
caccccctccccaggctgattggcgcttctgcggcggatcctcgggcgggcagccgggccggcgcgtcacgtggcccacggcgtccagggcgaccagccgcgggccgcagggcatggaccttcaggccgccggggcccaggcgcagggggccgcggagccgtctcggggcccgccgctgcctagcgcgcggggggcgccccccagcccggaggctggctttgctacagctgaccactccggtcaggagagagagactgagaaggctatggatcgactagcccgtggaacacagagcattcctaatgacagtcctgcccggggtgagggcacccattctgaagaggaaggctttgccatggatgaggaggactctgatggagaactgaatacctgggagctgtcagaagggacaaactgtccacccaaggaacagcctggcgatctttttaatgaggactgggactcggagttgaaagcagatcaagggaatccatatgatgctgacgacatccaggagagcatttctcaagagcttaaaccttgggtgtgctgtgccccacaaggagacatgatctatgaccccagctggcaccatccgcctccactgataccctattattccaagatggtctttgaaacaggacagtttgacgatgctgaagattgagtgtggagctttctgccttgtaggtgggcgggcctccacgtcaagatctcttttcctgtcttggaggtgaaaagtcatatctgagaaaatgtttgcagtgacccctagtctggggtacacagaccagtgttccttattgacagtgttcaataaggccccgtcattctcgccagtctgttgttgttcttaatgggctcctccttgaaatgtgtgtgtgtttgtgtcaagaggagttgtgttctttgtaaataaaggttaaaaagagaaa

SEQ ID NO: 307746 - DNA, 505 bp, Homo sapiens
actactactactactaaattctgcggccgctccgacgagttgaaagcagatcaagggaatccatatgatgctgacgacatccaggagagcatttctcaagagcttaaaccttgggtgtgctgtgccccacaaggagacatgatctatgaccccagctggcaccatccgcctccactgataccctattattccaagatggtctttgaaacaggacagtttgacgatgctgaagattgagtgtggagctttctgccttgtaggtgggcgggcctccacgtcaagatctcttttcctgtcttggaggtgaaaagtcatatctgagaaaatgtttgcagtgacccctagtctggggtacacagaccagtgttccttattgacagtgttcaataaggccccgtcattctcgccagtctgttgttgttcttaatgggctcctccttgaaatgtgtgtgtgtttgtgtcaagaggagttgtgttctttgtaaataaaggttaaaaagagaaa

SEQ ID NO: 307747 - DNA, 1235 bp, Homo sapiens
  misc_feature (910)..(910): n is a, c, g, or t
  misc_feature (1235)..(1235): n is a, c, g, or t
caccccctccccaggctgattggcgcttctgcggcggatcctcgggcgggcagccgggccggcgcgtcacgtggcccacggcgtccagggcgaccagccgcgggccgcagggcatggaccttcaggccgccggggcccaggcgcagggggccgcggagccgtctcggggcccgccgctgcctagcgcgcggggggcgccccccagcccggaggctggctttgctacagctgaccactccggtcaggagagagagactgagaaggctatggatcgactagcccgtggaacacagagcattcctaatgacagtcctgcccggggtgagggcacccattctgaagaggaaggctttgccatggatgaggaggactctgatggagaactgaatacctgggagctgtcagaagggacaaactgtccacccaaggaacagcctggcgatctttttaatgaggactgggactcggagttgaaagcagatcaagggaatccatatgatgctgacgacatccaggagagcatttctcaagagcttaaaccttgggtgtgctgtgccccacaaggagacatgatctatgaccccagctggcaccatccgcctccactgataccctattattccaagatggtctttgaaacaggacagtttgacgatgctgaagattgagtgtggagctttctgccttgtaggtgggcgggcctccacgtcaagatctcttttcctgtcttggaggtgaaaagtcatatctgagaaaatgtttgcagtgacccctagtctggggtacacagaccagtgttccttattgacagtgttcaataaggccccgtcattctcgccagtctgttgttgttcttaatgggctcctccttgaaatgtgtgtgtgtttgtgtcaagaggagtggggtctnggcaactacaaggggtaaaaggggagaaggcagaaaaaaagaatgtggggggtaattagtaggggggggaacaagaggtatgtaatgtgcatgtgtgaatgtgtttctgacacgattttttacaggggagaatagcgggcacaaaagggggggaattgaacgtaagagaaggactacggaagaagtatagtaggattagcgtattagtagcagtgtaggggaaataagatcagtgtgaagagagagagtacaagagatagctagtaagtgaagtgagtatacaaatggtaggtctagcatataagtaactacctattagtatagn

SEQ ID NO: 307748 - DNA, 412 bp, Homo sapiens
aacggccaggccgcggggccgcggggctgcggggcggggaaagccgagggcgtgggtgggcgctccgggtcagcagagacggctgtccgcccgctgggcgccgctgcggatttggtaaatgggaggtgacgctggtgaccgagagccggggcccgctgccaggagcctgggcgagggccaggctggctttgctacagctgaccactccggtcaggagagagagactgagaaaatgtttgcagtgacccctagtctggggtacacagaccagtgttccttattgacagtgttcaataaggccccgtcattctcgccagtctgttgttgttcttaatgggctcctccttgaaatgtgtgtgtgtttgtgtcaagaggagttgtgttctttgtaaataaaggttaaaaagagaaa

SEQ ID NO: 307749 - DNA, 997 bp, Homo sapiens
aaggacaaaaccaacgatttagggaccacaaggactcggaggatccacaaggttggacaaaaagccaggcttgaaaaccgacgcccagtaactataaccggtctaaagtacgagcctgggtggcgatttcggcaacgaagggcgtccagggcgaccagccgcgggccgcagggcatggaccttcaggccgccggggcccaggcgcagggggccgcggagccgtctcggggcccgccgctgcctagcgcgcggggggcgccccccagcccggaggctggctttgctacagctgaccactccggtcaggagagagagactgagaaggctatggatcgactagcccgtggaacacagagcattcctaatgacagtcctgcccggggtgagggcacccattctgaagaggaaggctttgccatggatgaggaggactctgatggagaactgaatacctgggagctgtcagaagggacaaactgtccacccaaggaacagcctggcgatctttttaatgaggactgggactcggagttgaaagcagatcaagggaatccatatgatgctgacgacatccaggagagcatttctcaagagcttaaaccttgggtgtgctgtgccccacaaggagacatgatctatgaccccagctggcaccatccgcctccactgataccctattattccaagatggtctttgaaacaggacagtttgacgatgctgaagattgagtgtggagctttctgccttgtaggtgggcgggcctccacgtcaagatctcttttcctgtcttggaggtgaaaagtcatatctgagaaaatgtttgcagtgacccctagtctggggtacacagaccagtgttccttattgacagtgttcaataaggccccgtcattctcgccagtctgttgttgttcttaatgggctcctccttgaaatgtgtgtgtgtttgtgtcaagaggagttgtgttctttgtaaataaaggttaaaaagagaaa

SEQ ID NO: 307750 - DNA, 1003 bp, Homo sapiens
caccccctccccaggctgattggcgcttctgcggcggatcctcgggcgggcagccgggccggcgcgtcacgtggcccacggcgtccagggcgaccagccgcgggccgcagggcatggaccttcaggccgccggggcccaggcgcagggggccgcggagccgtctcggggcccgccgctgcctagcgcgcggggggcgccccccagcccggaggctggctttgctacagctgaccactccggtcaggagagagagactgagaaggctatggatcgactagcccgtggaacacagagcattcctaatgacagtcctgcccggggtgagggcacccattctgaagaggaaggctttgccatggatgaggaggactctgatggagaactgaatacctgggagctgtcagaagggacaaactgtccacccaaggaacagcctggcgatctttttaatgaggactgggactcggagttgaaagcagatcaagggaatccatatgatgctgacgacatccaggagagcatttctcaagagcttaaaccttgggtgtgctgtgccccacaaggagacatgatctatgaccccagctggcaccatccgcctccactgataccctattattccaagatggtctttgaaacaggacagtttgacgatgctgaagattgagtgtggagctttctgccttgtaggtgggcgggcctccacgtcaagatctcttttcctgtcttggaggtgaaaagtcatatctgagaaaatgtttgcagtgacccctagtctggggtacacagaccagtgttccttattgacagtgttcaataaggccccgtcattctcgccagtctgttgttgttcttaatgggctcctccttgaaatgtgtgtgtgtttgtgtcaagaggagttgtgttctttgtaaataaaggttaaaaagagaaaaaaaaaagaaagaaaagaaaagagagaaaaaggagagaaggggagggagaagaaagaaaagaggaga

SEQ ID NO: 307751 - DNA, 980 bp, Homo sapiens
  misc_feature (938)..(938): n is a, c, g, or t
  misc_feature (943)..(943): n is a, c, g, or t
caccccctccccaggctgattggcgcttctgcggcggatcctcgggcgggcagccgggccggcgcgtcacgtggcccacggcgtccagggcgaccagccgcgggccgcagggcatggaccttcaggccgccggggcccaggcgcagggggccgcggagccgtctcggggcccgccgctgcctagcgcgcggggggcgccccccagcccggaggctggctttgctacagctgaccactccggtcaggagagagagactgagaaggctatggatcgactagcccgtggaacacagagcattcctaatgacagtcctgcccggggtgagggcacccattctgaagaggaaggctttgccatggatgaggaggactctgatggagaactgaatacctgggagctgtcagaagggacaaactgtccacccaaggaacagcctggcgatctttttaatgaggactgggactcggagttgaaagcagatcaagggaatccatatgatgctgacgacatccaggagagcatttctcaagagcttaaaccttgggtgtgctgtgccccacaaggagacatgatctatgaccccagctggcaccatccgcctccactgataccctattattccaagatggtctttgaaacaggacagtttgacgatgctgaagattgagtgtggagctttctgccttgtaggtgggcgggcctccacgtcaagatctcttttcctgtcttggaggtgaaaagtcatatctgagaaaatgtttgcagtgacccctagtctggggtacacagaccagtgttccttattgacagtgttcaataaggccccgtcattctcgccagtctgttgttgttcttaatgggctcctccttgaaatgtgtgtgtgtttgtgtcaagaggagttgtgttctttgtaaataaaggttaaaaagagaaacncacgnagaaacccaggctagaacaacacacaacacgggggcg

SEQ ID NO: 307752 - DNA, 971 bp, Homo sapiens
  misc_feature (938)..(938): n is a, c, g, or t
caccccctccccaggctgattggcgcttctgcggcggatcctcgggcgggcagccgggccggcgcgtcacgtggcccacggcgtccagggcgaccagccgcgggccgcagggcatggaccttcaggccgccggggcccaggcgcagggggccgcggagccgtctcggggcccgccgctgcctagcgcgcggggggcgccccccagcccggaggctggctttgctacagctgaccactccggtcaggagagagagactgagaaggctatggatcgactagcccgtggaacacagagcattcctaatgacagtcctgcccggggtgagggcacccattctgaagaggaaggctttgccatggatgaggaggactctgatggagaactgaatacctgggagctgtcagaagggacaaactgtccacccaaggaacagcctggcgatctttttaatgaggactgggactcggagttgaaagcagatcaagggaatccatatgatgctgacgacatccaggagagcatttctcaagagcttaaaccttgggtgtgctgtgccccacaaggagacatgatctatgaccccagctggcaccatccgcctccactgataccctattattccaagatggtctttgaaacaggacagtttgacgatgctgaagattgagtgtggagctttctgccttgtaggtgggcgggcctccacgtcaagatctcttttcctgtcttggaggtgaaaagtcatatctgagaaaatgtttgcagtgacccctagtctggggtacacagaccagtgttccttattgacagtgttcaataaggccccgtcattctcgccagtctgttgttgttcttaatgggctcctccttgaaatgtgtgtgtgtttgtgtcaagaggagttgtgttctttgtaaataaaggttaaaaagagaaaanacacaaaaactcggacatattccctttctttcc

SEQ ID NO: 307753 - DNA, 905 bp, Homo sapiens
aacggccaggccgcggggccgcggggctgcggggcggggaaagccgagggcgtgggtgggcgctccgggtcagcagagacggctgtccgcccgctgggcgccgctgcggatttggtaaatgggaggtgacgctggtgaccgagagccggggcccgctgccaggagcctgggcgagggccaggctggctttgctacagctgaccactccggtcaggagagagagactgagaaggctatggatcgactagcccgtggaacacagagcattcctaatgacagtcctgcccggggtgagggcacccattctgaagaggaaggctttgccatggatgaggaggactctgatggagaactgaatacctgggagctgtcagaagggacaaactgtccacccaaggaacagcctggcgatctttttaatgaggactgggactcggagttgaaagcagatcaagggaatccatatgatgctgacgacatccaggagagcatttctcaagagcttaaaccttgggtgtgctgtgccccacaaggagacatgatctatgaccccagctggcaccatccgcctccactgataccctattattccaagatggtctttgaaacaggacagtttgacgatgctgaagattgagtgtggagctttctgccttgtaggtgggcgggcctccacgtcaagatctcttttcctgtcttggaggtgaaaagtcatatctgagaaaatgtttgcagtgacccctagtctggggtacacagaccagtgttccttattgacagtgttcaataaggccccgtcattctcgccagtctgttgttgttcttaatgggctcctccttgaaatgtgtgtgtgtttgtgtcaagaggagttgtgttctttgtaaataaaggttaaaaagagaaa

SEQ ID NO: 307754 - DNA, 1083 bp, Homo sapiens
caccccctccccaggctgattggcgcttctgcggcggatcctcgggcgggcagccgggccggcgcgtcacgtggcccacggcgtccagggcgaccagccgcgggccgcagggcatggaccttcaggccgccggggcccaggcgcagggggccgcggagccgtctcggggcccgccgctgcctagcgcgcggggggcgccccccagcccggaggctggctttgctacagctgaccactccggtcaggagagagagactgagaaggctatggatcgactagccagtcctctctgctgcttagtggccttctctgcccagttgaacagtaacctcctttggaagccttgcttggagcttccttaagggaagtcctgaacttttcttatgttcaaatccatccttctaccgagagaaacagcttgaaacgcccgtggaacacagagcattcctaatgacagtcctgcccggggtgagggcacccattctgaagaggaaggctttgccatggatgaggaggactctgatggagaactgaatacctgggagctgtcagaagggacaaactgtccacccaaggaacagcctggcgatctttttaatgaggactgggactcggagttgaaagcagatcaagggaatccatatgatgctgacgacatccaggagagcatttctcaagagcttaaaccttgggtgtgctgtgccccacaaggagacatgatctatgaccccagctggcaccatccgcctccactgataccctattattccaagatggtctttgaaacaggacagtttgacgatgctgaagattgagtgtggagctttctgccttgtaggtgggcgggcctccacgtcaagatctcttttcctgtcttggaggtgaaaagtcatatctgagaaaatgtttgcagtgacccctagtctggggtacacagaccagtgttccttattgacagtgttcaataaggccccgtcattctcgccagtctgttgttgttcttaatgggctcctccttgaaatgtgtgtgtgtttgtgtcaagaggagttgtgttctttgtaaataaaggttaaaaagagaaa

SEQ ID NO: 307755 - DNA, 885 bp, Homo sapiens
caccccctccccaggctgattggcgcttctgcggcggatcctcgggcgggcagccgggccggcgcgtcacgtggcccacggcgtccagggcgaccagccgcgggccgcagggcatggaccttcaggccgccggggcccaggcgcagggggccgcggagccgtctcggggcccgccgctgcctagcgcgcggggggcgccccccagcccggaggctggctttgctacagctgaccactccggtcaggagagagagactgagaaggctatggatcgactagcccgtggaacacagagcattcctaatgacagtcctgcccggggtgagggcacccattctgaagaggaaggctttgccatggatgaggaggactctgatggagaactgaatacctgggagctgtcagaagggacaaactgtccacccaaggaacagcctggcgatctttttaatgaggactgggactcggagttgaaagcagatcaagggaatccatatgatgctgacgacatccaggagagcatttctcaagagcttaaaccttgggtgtgctgtgccccacaaggagacatgatctatgaccccagctggcaccatccgcctccactgataccctattattccaagatggtctttgaaacaggacagtttgacgatgctgaagattgagtgtggagctttctgccttgtaggtgggcgggcctccacgtcaagatctcttttcctgtcttggaggtgaaaagtcatatctgagaaaatgtttgcagtgacccctagtctggggtacacagaccagtgttgttcttaatgggctcctccttgaaatgtgtgtgtgtttgtgtcaagaggagttgtgttctttgtaaataaaggttaaaaagagaaa

SEQ ID NO: 307756 - DNA, 854 bp, Homo sapiens
aacggccaggccgcggggccgcggggctgcggggcggggaaagccgagggcgtgggtgggcgctccgggtcagcagagacggctgtccgcccgctgggcgccgctgcggatttggtaaatgggaggtgacgctggtgaccgagagccggggcccgctgccaggagcctgggcgagggccaggctggctttgctacagctgaccactccggtcaggagagagagactgagaaggctatggatcgactagcccgtggaacacagagcattcctaatgacagtcctgcccggggtgagggcacccattctgaagaggaaggctttgccatggatgaggaggactctgatggagaactgaatacctgggagctgtcagaagggacaaactgtccacccaaggaacagcctggcgatctttttaatgaggactgggactcggagttgaaagcagatcaagggaatccatatgatgctgacgacatccaggagagcatttctcaagagcttaaaccttgggtgtgctgtgccccacaaggagacatgatctatgaccccagctggcaccatccgcctccactgataccctattattccaagatggtctttgaaacaggacagtttgacgatgctgaagattgagtgtggagctttctgccttgtaggtgggcgggcctccacgtcaagatctcttttcctgtcttggaggtgaaaagtcatatctgagaaaatgtttgcagtgacccctagtctggggtacacagaccagtgttgttcttaatgggctcctccttgaaatgtgtgtgtgtttgtgtcaagaggagttgtgttctttgtaaataaaggttaaaaagagaaa

SEQ ID NO: 307757 - DNA, 327 bp, Homo sapiens
ctttgaaacaggacagtttgacgatgctgaagattgagtgtggagctttctgccttgtaggtgggcgggcctccacgtcaagatctcttttcctgtcttggaggtgaaaagtcatatctgagaaaatgtttgcagtgacccctagtctggggtacacagaccagtgttccttattgacagtgttcaataaggccccgtcattctcgccagtctgttgttgttcttaatgggctcctccttgaaatgtgtgtgtgtttgtgtcaagaggagttgtgttctttgtaaataaaggttaaaaagagaaagaaaccagtatgcttcgtctgc

SEQ ID NO: 307758 - DNA, 834 bp, Homo sapiens
  misc_feature (824)..(824): n is a, c, g, or t
gcaacttgggcttggcaggatgaagggggagaactgctccaagccgagctaatttttgtaatttttagtagaggtgggatttcaccatcttagccaggctggtctcaaactcctgacctcaggtgatccacccgcctcggcctcccaaagtgctgggatgacaggcgtgagccactgcacctggcctggtggttagtgttttcatagattcttccaggcttttcagtttaacgcatgtctgtgctttaatgaagaaatggggtcgtgctgtgtgtgcccagtgactgactgttagggaacatgtgtctgtgccttaatgaagaaatggggtcgtgctgtgtgtgcccagtgactgactgttagggaacatgtgtctgtgctttaatgaagaaatggggtcgtgctgtgtgtgcccagtgactgactgttagtcaggggtgttggccttactcatgtctggagtgcgtccctgcaggctcttggcctggtgagctctgggtacagctgtgcagtcgcctaccggcgccttctgtacctgcagtccacttagcttgcgtggctgtgtgtggtgacccacggctctccctctcctcccatcgccctcatgccccagagctgagccccacagccccttctcttgggtgcctgtgttcacatgaatgtgtaaacacgtgcgtgtctgtgtacaaagacaaggctttctttacgggttgacggccttaatggttcctgctcttcctgttacatagaggcccttcctatccattttttttttttctcagagtgatattgcatagatttcctcacatgccactcaataccangtcctctaga

SEQ ID NO: 307759 - DNA, 1510 bp, Homo sapiens
gaccacacggccgccggaggcacagtcgtgttcgcatctggtctaacagacccgcgagaacgaaggacgcttgcctttttccggtcggggaagggggaagaaggtaacttccggtgacggggttgcatcacttcctctcaagcttggcgtttgtttggtggggttacacgcgggttcaacatgcgtatcgaaaagtgttatttctgttcggggcccatctatcctggacacggcatgatgttcgtccgcaacgattgcaaggtgttcagattttgcaaatctaaatgtcataaaaactttaaaaagaagcgcaatcctcgcaaagttaggtggaccaaagcattccggaaagcagctggtaaagagcttacagtggataattcatttgaatttgaaaaacgtagaaatgaacctatcaaataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaagcgattaaaagacatctttcctgcattgccatctacataatatcagatattacggatgttagattgcatctcagtgttaaatctttactgatagatgtacttaagtaaatcatgaaaattctacttgtaactatagaagtgaattgtggacgtaaaatggttgtgctatttggataatggcactaggcagcatttgtatagtaactaatggcaaaaattcatggctagtgatgtataaaataaaatattctttgcagtaaaatattccctttgttaatgttatagaaggggggatacaaaaaggaactaacaatttgtatggcagtgtcagatatttttattttagtatttcctgttttggtttatttgcatcttagaagagcataatgacattgtttgatgaagcctaattatgctggactgttttgacctggtttaacccttctgataggtagttgtggatgctggggatgagaactgaataatctttgcctggagtgacactacactctagaatttccactttggagaatactcagttccaacttgtgattcctgatagaacagactttacttttctagcccagcattgatctagaagcagaggaatcccagcgccttttaaaagttgttatgtggttttcttttaaaaagctcctgtttttggaaagtagaatttatgggtacaacgtatgttcattatttgtacataaaataaaaccatttaaaaagtaa

SEQ ID NO: 307760 - DNA, 1033 bp, Homo sapiens
gaccacacggccgccggaggcacagtcgtgttcgcatctggtctaacagacccgcgagaacgaaggacgcttgcctttttccggtcggggaagggggaagaaggtaacttccggtgacggggttgcatcacttcctctcaagcttggcgtttgtttggtggggttacacgcgggttcaacatgcgtatcgaaaagtgttatttctgttcggggcccatctatcctggacacggcatgatgttcgtccgcaacgattgcaaggtgttcagattttgcaaatctaaatgtcataaaaactttaaaaagaagcgcaatcctcgcaaagttaggtggaccaaagcattccggaaagcagctggtaaagagcttacagtggataattcatttgaatttgaaaaacgtagaaatgaacctatcaaataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaagcgattaaaagacatctttcctgcattgccatctacataatatcagatattacggatgttagattgcatctcagtgttaaatctttactgatagatgtacttaagtaaatcatgaaaattctacttgtaactatagaagtgaattgtggacgtaaaatggttgtgctatttggataatggcactaggcagcatttgtatagtaactaatggcaaaaattcatggctagtgatgtataaaataaaatattctttgcagt

SEQ ID NO: 307761 - DNA, 574 bp, Homo sapiens
gcataatgacattgtttgatgaagcctaattatgctggactgttttgacctggtttaaccaaaacaggaaatactaaaataaaatattctttgcagtaaaatattccctttgttaatgttatagaaggggggatacaaaaaggaactaacaatttgtatggcagtgtcagatatttttattttagtatttcctgttttggtttatttgcatcttagaagagcataatgacattgtttgatgaagcctaattatgctggactgttttgacctggtttaacccttctgataggtagttgtggatgctggggatgagaactgaataatctttgcctggagtgacactacactctagaatttccactttggagaatactcagttccaacttgtgattcctgatagaacagactttacttttctagcccagcattgatctagaagcagaggaatcccagcgccttttaaaagttgttatgtggttttcttttaaaaagctcctgtttttggaaagtagaatttatgggtacaacgtatgttcattatttgtacataaaataaaaccatttaaaaagtaa

SEQ ID NO: 307762 - DNA, 347 bp, Homo sapiens
caaagacacattgtagcaggcaaatttattagttctgttggtatgctctaaaacaaatcatgttataaccaatagtgactgttgactggtaaccttataggagtggatgtggataaactaaaatcttgctgaggcatcattaaattccttgaaaatcagtcactgtatctgaagaacagactttacttttctagcccagcattgatctagaagcagaggaatcccagcgccttttaaaagttgttatgtggttttcttttaaaaagctcctgtttttggaaagtagaatttatgggtacaacgtatgttcattatttgtacataaaataaaaccatttaaaaagtaa

SEQ ID NO: 307763 - DNA, 1656 bp, Homo sapiens
gaccacacggccgccggaggcacagtcgtgttcgcatctggtctaacagacccgcgagaacgaaggacgcttgcctttttccggtcggggaagggggaagaaggtaacttccggtgacggggttgcatcacttcctctcaagcttggcgtttgtttggtggggttacacgcgggttcaacatgcgtatcgaaaagtgttatttctgttcggggcccatctatcctggacacggcatgatgttcgtccgcaacgattgcaaggtgttcagattttgcaaatctaaatgtcataaaaactttaaaaagaagcgcaatcctcgcaaagttaggtggaccaaagcattccggaaagcagctggtaaagagcttacagtggataattcatttgaatttgaaaaacgtagaaatgaacctatcaaataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaagcgattaaaagacatctttcctgcattgccatctacataatatcagatattacggatgttagattgcatctcagtgttaaatctttactgatagatgtacttaagtaaatcatgaaaattctacttgtaactatagaagtgaattgtggacgtaaaatggttgtgctatttggataatggcactaggcagcatttgtatagtaactaatggcaaaaattcatggctagtgatgtataaaataaaatattctttgcagtaaaatattccctttgttaatgttatagaaggggggatacaaaaaggaactaacaatttgtatggcagtgtcagatatttttattttagtatttcctgttttggtttatttgcatcttagaagagcataatgacattgtttgatgaagcctaattatgctggactgttttgacctggtttaacccttctgataggtagttgtggatgctggggatgagaactgaataatctttgcctggagtgacactacactctagaatttccactttggagaatactcagttccaacttgtgattcctgatagaacagactttacttttctagcccagcattgatctagaagcagaggaatcccagcgccttttaaaagttgttatgtggttttcttttaaaaagctcctgtttttggaaagtagaatttatgggtacaacgtatgttcattatttgtacataaaataaaaccatttaaaaagtaaccacaacacaccacccccaccaaaaaacttttccggcgcgctctgccccgaaaaagcttcaaacccttcgttgggccgcggggccatgggtttgcacctggccctacgggttcccagggaaaccgggcacaaccgggtggtttccc

SEQ ID NO: 307764 - DNA, 1587 bp, Homo sapiens
gaccacacggccgccggaggcacagtcgtgttcgcatctggtctaacagacccgcgagaacgaaggacgcttgcctttttccggtcggggaagggggaagaaggtaacttccggtgacggggttgcatcacttcctctcaagcttggcgtttgtttggtggggttacacgcgggttcaacatgcgtatcgaaaagtgttatttctgttcggggcccatctatcctggacacggcatgatgttcgtccgcaacgattgcaaggtgttcagattttgcaaatctaaatgtcataaaaactttaaaaagaagcgcaatcctcgcaaagttaggtggaccaaagcattccggaaagcagctggtaaagagcttacagtggataattcatttgaatttgaaaaacgtagaaatgaacctatcaaataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaagcgattaaaagacatctttcctgcattgccatctacataatatcagatattacggatgttagattgcatctcagtgttaaatctttactgatagatgtacttaagtaaatcatgaaaattctacttgtaactatagaagtgaattgtggacgtaaaatggttgtgctatttggataatggcactaggcagcatttgtatagtaactaatggcaaaaattcatggctagtgatgtataaaataaaatattctttgcagtaaaatattccctttgttaatgttatagaaggggggatacaaaaaggaactaacaatttgtatggcagtgtcagatatttttattttagtatttcctgttttggtttatttgcatcttagaagagcataatgacattgtttgatgaagcctaattatgctggactgttttgacctggtttaacccttctgataggtagttgtggatgctggggatgagaactgaataatctttgcctggagtgacactacactctagaatttccactttggagaatactcagttccaacttgtgattcctgatagaacagactttacttttctagcccagcattgatctagaagcagaggaatcccagcgccttttaaaagttgttatgtggttttcttttaaaaagctcctgtttttggaaagtagaatttatgggtacaacgtatgttcattatttgtacataaaataaaaccatttaaaaagtaataatgctgatatttattctttaaaggcactaaacaaagatatgaaatattgatgacctggaagaagaaatcttcctc

SEQ ID NO: 307765 - DNA, 1418 bp, Homo sapiens
aagcactggtatcaacgcagagtggccattacggccgggttcctctcaagcttggcgtttgtttggtggggttacacgcgggttcaacatgcgtatcgaaaagtgttatttctgttcggggcccatctatcctggacacggcatgatgttcgtccgcaacgattgcaaggtgttcagattttgcaaatctaaatgtcataaaaactttaaaaagaagcgcaatcctcgcaaagttaggtggaccaaagcattccggaaagcagctggtaaagagcttacagtggataattcatttgaatttgaaaaacgtagaaatgaacctatcaaataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaagcgattaaaagacatctttcctgcattgccatctacataatatcagatattacggatgttagattgcatctcagtgttaaatctttactgatagatgtacttaagtaaatcatgaaaattctacttgtaactatagaagtgaattgtggacgtaaaatggttgtgctatttggataatggcactaggcagcatttgtatagtaactaatggcaaaaattcatggctagtgatgtataaaataaaatattctttgcagtaaaatattccctttgttaatgttatagaaggggggatacaaaaaggaactaacaatttgtatggcagtgtcagatatttttattttagtatttcctgttttggtttatttgcatcttagaagagcataatgacattgtttgatgaagcctaattatgctggactgttttgacctggtttaacccttctgataggtagttgtggatgctggggatgagaactgaataatctttgcctggagtgacactacactctagaatttccactttggagaatactcagttccaacttgtgattcctgatagaacagactttacttttctagcccagcattgatctagaagcagaggaatcccagcgccttttaaaagttgttatgtggttttcttttaaaaagctcctgtttttggaaagtagaatttatgggtacaacgtatgttcattatttgtacataaaataaaaccatttaaaaagtaa

SEQ ID NO: 307766 - DNA, 1357 bp, Homo sapiens
  misc_feature (1198)..(1198): n is a, c, g, or t
  misc_feature (1209)..(1209): n is a, c, g, or t
  misc_feature (1213)..(1213): n is a, c, g, or t
  misc_feature (1219)..(1219): n is a, c, g, or t
  misc_feature (1224)..(1225): n is a, c, g, or t
  misc_feature (1229)..(1229): n is a, c, g, or t
  misc_feature (1242)..(1242): n is a, c, g, or t
gaccacacggccgccggaggcacagtcgtgttcgcatctggtctaacagacccgcgagaacgaaggacgcttgcctttttccggtcggggaagggggaagaaggtaacttccggtgacggggttgcatcacttcctctcaagcttggcgtttgtttggtggggttacacgcgggttcaacatgcgtatcgaaaagtgttatttctgttcggggcccatctatcctggacacggcatgatgttcgtccgcaacgattgcaaggtgttcagattttgcaaatctaaatgtcataaaaactttaaaaagaagcgcaatcctcgcaaagttaggtggaccaaagcattccggaaagcagctggtaaagagcttacagtggataattcatttgaatttgaaaaacgtagaaatgaacctatcaaataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaagcgattaaaagacatctttcctgcattgccatctacataatatcagatattacggatgttagattgcatctcagtgttaaatctttactgatagatgtacttaagtaaatcatgaaaattctacttgtaactatagaagtgaattgtggacgtaaaatggttgtgctatttggataatggcactaggcagcatttgtatagtaactaatggcaaaaattcatggctagtgatgtataaaataaaatattctttgcagtaaaatattccctttgttaatgttatagaaggggggatacaaaaaggaactaacaatttgtatggcagtgtcagatatttttattttagtatttcctgttttggtttatttgcatcttagaagagcataatgacattgtttgatgaagcctaattatgctggacgnccgttaccccnaagnatgtgncgggnngacngaaactgcggganacccaaacttggaaacctccctgtgccgtaaaacctttgccccgttcaagaaccgccaatatggttacccggaaagcggctttacaaaaaaaaacgcccgggggtagggcgacag

SEQ ID NO: 307767 - DNA, 1055 bp, Homo sapiens
  misc_feature (1004)..(1004): n is a, c, g, or t
  misc_feature (1008)..(1008): n is a, c, g, or t
  misc_feature (1026)..(1026): n is a, c, g, or t
gaccacacggccgccggaggcacagtcgtgttcgcatctggtctaacagacccgcgagaacgaaggacgcttgcctttttccggtcggggaagggggaagaaggtaacttccggtgacggggttgcatcacttcctctcaagcttggcgtttgtttggtggggttacacgcgggttcaacatgcgtatcgaaaagtgttatttctgttcggggcccatctatcctggacacggcatgatgttcgtccgcaacgattgcaaggtgttcagattttgcaaatctaaatgtcataaaaactttaaaaagaagcgcaatcctcgcaaagttaggtggaccaaagcattccggaaagcagctggtaaagagcttacagtggataattcatttgaatttgaaaaacgtagaaatgaacctatcaaataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaagcgattaaaagacatctttcctgcattgccatctacataatatcagatattacggatgttagattgcatctcagtgttaaatctttactgatagatgtacttaagtaaatcatgaaaattctacttgtaactatagaagtgaatttggggcgaacgggggcatggaaggccagcgccttgttttacatggcaaaccggcgggttaaaaatttgggcgaaaaaaaaaaangggngggccaaaaaaagtgggngaaaaaagggcaagaggtccacgcggaag

SEQ ID NO: 307768 - DNA, 991 bp, Homo sapiens
gaccacacggccgccggaggcacagtcgtgttcgcatctggtctaacagacccgcgagaacgaaggacgcttgcctttttccggtcggggaagggggaagaaggtaacttccggtgacggggttgcatcacttcctctcaagcttggcgtttgtttggtggggttacacgcgggttcaacatgcgtatcgaaaagtgttatttctgttcggggcccatctatcctggacacggcatgatgttcgtccgcaacgattgcaaggtgttcagattttgcaaatctaaatgtcataaaaactttaaaaagaagcgcaatcctcgcaaagttaggtggaccaaagcattccggaaagcagctggtaaagagcttacagtggataattcatttgaatttgaaaaacgtagaaatgaacctatcaaataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaagcgattaaaagacatctttcctgcattgccatctacataatatcagatattacggatgttagattgcatctcagtgttaaatctttactgatagatgtacttaagtaaatcatgaaaattctacttgtaactatagaagtgaattgatgtgctaattggtatggactagcagcttgtattactatggaaatcggtgtgttttaataaattttgcgg

SEQ ID NO: 307769 - DNA, 1456 bp, Homo sapiens
gaccacacggccgccggaggcacagtcgtgttcgcatctggtctaacagacccgcgagaacgaaggacgcttgcctttttccggtcggggaagggggaagaaggtaacttccggtgacggggttgcatcacttcctctcaagcttggcgtttgtttggtggggttacacgcgggttcaacatgcgtatcgaaaagtgttatttctgttcggggcccatctatcctggacacggcatgatgttcgtccgcaacgattgcaaggtgttcagattttgcaaatctaaatgtcataaaaactttaaaaagaagcgcaatcctcgcaaagttaggtggaccaaagcattccggaaagcagctggtaaagagcttacagtggataattcatttgaatttgaaaaacgtagaaatgaacctatcaaataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaggatgttagattgcatctcagtgttaaatctttactgatagatgtacttaagtaaatcatgaaaattctacttgtaactatagaagtgaattgtggacgtaaaatggttgtgctatttggataatggcactaggcagcatttgtatagtaactaatggcaaaaattcatggctagtgatgtataaaataaaatattctttgcagtaaaatattccctttgttaatgttatagaaggggggatacaaaaaggaactaacaatttgtatggcagtgtcagatatttttattttagtatttcctgttttggtttatttgcatcttagaagagcataatgacattgtttgatgaagcctaattatgctggactgttttgacctggtttaacccttctgataggtagttgtggatgctggggatgagaactgaataatctttgcctggagtgacactacactctagaatttccactttggagaatactcagttccaacttgtgattcctgatagaacagactttacttttctagcccagcattgatctagaagcagaggaatcccagcgccttttaaaagttgttatgtggttttcttttaaaaagctcctgtttttggaaagtagaatttatgggtacaacgtatgttcattatttgtacataaaataaaaccatttaaaaagtaa

SEQ ID NO: 307770 - DNA, 799 bp, Homo sapiens
gaccacacggccgccggaggcacagtcgtgttcgcatctggtctaacagacccgcgagaacgaaggacgcttgcctttttccggtcggggaagggggaagaaggtaacttccggtgacggggttgcatcacttcctctcaagcttggcgtttgtttggtggggttacacgcgggttcaacatgcgtatcgaaaagtgttatttctgttcggggcccatctatcctggacacggcatgatgttcgtccgcaacgattgcaaggtgttcagattttgcaaatctaaatgtcataaaaactttaaaaagaagcgcaatcctcgcaaagttaggtggaccaaagcattccggaaagcagctggtaaagagcttacagtggataattcatttgaatttgaaaaacgtagaaatgaacctatcaaataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaagcgattaaaagacatctttcctgc

SEQ ID NO: 307771 - DNA, 1492 bp, Homo sapiens
  misc_feature (11)..(11): n is a, c, g, or t
  misc_feature (23)..(23): n is a, c, g, or t
  misc_feature (75)..(75): n is a, c, g, or t
  misc_feature (88)..(88): n is a, c, g, or t
  misc_feature (94)..(94): n is a, c, g, or t
ctgctcttttntctcctcccttntttacacccatcccctcccccagaacaagcgcagagagagagaaatttgatnaccctttggaatncaccgngagggtgttggatctagaactagcggatcctccgggctgcaggaattcggcacgagcgcgggttcaacatgcgtatcgaaaagtgttatttctgttcggggcccatctatcctggacacggcatgatgttcgtccgcaacgattgcaaggtgttcagattttgcaaatctaaatgtcataaaaactttaaaaagaagcgcaatcctcgcaaagttaggtggaccaaagcattccggaaagcagctggtaaagagcttacagtggataattcatttgaatttgaaaaacgtagaaatgaacctatcaaataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaagcgattaaaagacatctttcctgcattgccatctacataatatcagatattacggatgttagattgcatctcagtgttaaatctttactgatagatgtacttaagtaaatcatgaaaattctacttgtaactatagaagtgaattgtggacgtaaaatggttgtgctatttggataatggcactaggcagcatttgtatagtaactaatggcaaaaattcatggctagtgatgtataaaataaaatattctttgcagtaaaatattccctttgttaatgttatagaaggggggatacaaaaaggaactaacaatttgtatggcagtgtcagatatttttattttagtatttcctgttttggtttatttgcatcttagaagagcataatgacattgtttgatgaagcctaattatgctggactgttttgacctggtttaacccttctgataggtagttgtggatgctggggatgagaactgaataatctttgcctggagtgacactacactctagaatttccactttggagaatactcagttccaacttgtgattcctgatagaacagactttacttttctagcccagcattgatctagaagcagaggaatcccagcgccttttaaaagttgttatgtggttttcttttaaaaagctcctgtttttggaaagtagaatttatgggtacaacgtatgttcattatttgtacataaaataaaaccatttaaaaagtaa

SEQ ID NO: 307772 - DNA, 1441 bp, Homo sapiens
gaccacacggccgccggaggcacagtcgtgttcgcatctggtctaacagacccgcgagaacgaaggacgcttgcctttttccggtcggggaagggggaagaaggtaacttccggtgacggggttgcatcacttcctctcaagcttggcgtttgtttggtggggttacacgcgggttcaacatgcgtatcgaaaagtgttatttctgttcggggcccatctatcctggacacggcatgatgttcgtccgcaacgattgcaaggtgttcagattttgcaaatctaaatgtcataaaaactttaaaaagaagcgcaatcctcgcaaagttaggtggaccaaagcattccggaaagcagctggtaaagagcttacagtggataattcatttgaatttgaaaaacgtagaaatgaacctatcaaataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaaataaaataatttagccctcacccttgctgggggcatatctctcatacccacctgctgaatcttctcttcacttgctgagaaagtcagaggaggggatccagtagccctttccacatactgtggctacagcacccagcactgtgctgttgttgtctgactgtggctatctctgtcccatcaccctgagcctcaagatggaagacattgtctgcttgaactctgggcttggtgcagagtaggtatttggtaaatgttgaatagatcaaccaattcctacagcccactgggtgccaagctcagaggggaaaaaaagatagccagagagagacctggcctcaaaaaggtgtgaacaagactgaaaaggaggtccgttcagctccgctgccctgtccctgcttggttctggaagtttttacaatatattccttgtaggttcttcactcactcactcaacaaatacccgttgggaagagtctttaactggggcttcaatgtgttggcctgcagtcatgtttcggttagtcaccagggtttattctatttaagaattcgaatgctttgggtaggatgccacccaggtcccaatgtttccggtgccccaaaaaaaacaattgcgttgttagcccataaaaggttacatgggccaacccaaacggggaaatctac

SEQ ID NO: 307773 - DNA, 1368 bp, Homo sapiens
  misc_feature (16)..(16): n is a, c, g, or t
  misc_feature (43)..(43): n is a, c, g, or t
ccacccctctctcctnccctttccttctacctcttgccacctncctccccatgtgttatttctgttcggggcccatctatcctggacacggcatgatgttcgtccgcaacgattgcaaggtgttcagattttgcaaatctaaatgtcataaaaactttaaaaagaagcgcaatcctcgcaaagttaggtggaccaaagcattccggaaagcagctggtaaagagcttacagtggataattcatttgaatttgaaaaacgtagaaatgaacctatcaaataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaagcgattaaaagacatctttcctgcattgccatctacataatatcagatattacggatgttagattgcatctcagtgttaaatctttactgatagatgtacttaagtaaatcatgaaaattctacttgtaactatagaagtgaattgtggacgtaaaatggttgtgctatttggataatggcactaggcagcatttgtatagtaactaatggcaaaaattcatggctagtgatgtataaaataaaatattctttgcagtaaaatattccctttgttaatgttatagaaggggggatacaaaaaggaactaacaatttgtatggcagtgtcagatatttttattttagtatttcctgttttggtttatttgcatcttagaagagcataatgacattgtttgatgaagcctaattatgctggactgttttgacctggtttaacccttctgataggtagttgtggatgctggggatgagaactgaataatctttgcctggagtgacactacactctagaatttccactttggagaatactcagttccaacttgtgattcctgatagaacagactttacttttctagcccagcattgatctagaagcagaggaatcccagcgccttttaaaagttgttatgtggttttcttttaaaaagctcctgtttttggaaagtagaatttatgggtacaacgtatgttcattatttgtacataaaataaaaccatttaaaaagtaa

SEQ ID NO: 307774 - DNA, 1352 bp, Homo sapiens
gaccacacggccgccggaggcacagtcgtgttcgcatctggtctaacagacccgcgagaacgaaggacgcttgcctttttccggtcggggaagggggaagaaggtgttcagattttgcaaatctaaatgtcataaaaactttaaaaagaagcgcaatcctcgcaaagttaggtggaccaaagcattccggaaagcagctggtaaagagcttacagtggataattcatttgaatttgaaaaacgtagaaatgaacctatcaaataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaagcgattaaaagacatctttcctgcattgccatctacataatatcagatattacggatgttagattgcatctcagtgttaaatctttactgatagatgtacttaagtaaatcatgaaaattctacttgtaactatagaagtgaattgtggacgtaaaatggttgtgctatttggataatggcactaggcagcatttgtatagtaactaatggcaaaaattcatggctagtgatgtataaaataaaatattctttgcagtaaaatattccctttgttaatgttatagaaggggggatacaaaaaggaactaacaatttgtatggcagtgtcagatatttttattttagtatttcctgttttggtttatttgcatcttagaagagcataatgacattgtttgatgaagcctaattatgctggactgttttgacctggtttaacccttctgataggtagttgtggatgctggggatgagaactgaataatctttgcctggagtgacactacactctagaatttccactttggagaatactcagttccaacttgtgattcctgatagaacagactttacttttctagcccagcattgatctagaagcagaggaatcccagcgccttttaaaagttgttatgtggttttcttttaaaaagctcctgtttttggaaagtagaatttatgggtacaacgtatgttcattatttgtacataaaataaaaccatttaaaaagtaa

SEQ ID NO: 307775 - DNA, 1402 bp, Homo sapiens
ggcttgtcgaatttggtgtcagagggcaggcgggtagatgcagtattcctgcgatgtcctatctgaaaggttgtcatagctaagtccgggtcccactctatgctgcaatccgcatgctgtacggccgcaccgatagcatggatgttcagagtgtggcaactctgtagttgtcttaataaactatatgcagttaaaaagaagcgcaatcctcgcaaagttaggtggaccaaagcattccggaaagcagctggtaaagagcttacagtggataattcatttgaatttgaaaaacgtagaaatgaacctatcaaataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaagcgattaaaagacatctttcctgcattgccatctacataatatcagatattacggatgttagattgcatctcagtgttaaatctttactgatagatgtacttaagtaaatcatgaaaattctacttgtaactatagaagtgaattgtggacgtaaaatggttgtgctatttggataatggcactaggcagcatttgtatagtaactaatggcaaaaattcatggctagtgatgtataaaataaaatattctttgcagtaaaatattccctttgttaatgttatagaaggggggatacaaaaaggaactaacaatttgtatggcagtgtcagatatttttattttagtatttcctgttttggtttatttgcatcttagaagagcataatgacattgtttgatgaagcctaattatgctggactgttttgacctggtttaacccttctgataggtagttgtggatgctggggatgagaactgaataatctttgcctggagtgacactacactctagaatttccactttggagaatactcagttccaacttgtgattcctgatagaacagactttacttttctagcccagcattgatctagaagcagaggaatcccagcgccttttaaaagttgttatgtggttttcttttaaaaagctcctgtttttggaaagtagaatttatgggtacaacgtatgttcattatttgtacataaaataaaaccatttaaaaagtaa

SEQ ID NO: 307776 - DNA, 1381 bp, Homo sapiens
aagcactggtatcaacgcagagtggccattacggccgggttcctctcaagcttggcgtttgtttggtggggttacacgcgggttcaacatgcgtatcgaaaagtgttatttctgttcggggcccatctatcctggacacggcatgatgttcgtccgcaacgattgcaagttaaaaagaagcgcaatcctcgcaaagttaggtggaccaaagcattccggaaagcagctggtaaagagcttacagtggataattcatttgaatttgaaaaacgtagaaatgaacctatcaaataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaagcgattaaaagacatctttcctgcattgccatctacataatatcagatattacggatgttagattgcatctcagtgttaaatctttactgatagatgtacttaagtaaatcatgaaaattctacttgtaactatagaagtgaattgtggacgtaaaatggttgtgctatttggataatggcactaggcagcatttgtatagtaactaatggcaaaaattcatggctagtgatgtataaaataaaatattctttgcagtaaaatattccctttgttaatgttatagaaggggggatacaaaaaggaactaacaatttgtatggcagtgtcagatatttttattttagtatttcctgttttggtttatttgcatcttagaagagcataatgacattgtttgatgaagcctaattatgctggactgttttgacctggtttaacccttctgataggtagttgtggatgctggggatgagaactgaataatctttgcctggagtgacactacactctagaatttccactttggagaatactcagttccaacttgtgattcctgatagaacagactttacttttctagcccagcattgatctagaagcagaggaatcccagcgccttttaaaagttgttatgtggttttcttttaaaaagctcctgtttttggaaagtagaatttatgggtacaacgtatgttcattatttgtacataaaataaaaccatttaaaaagtaa

SEQ ID NO: 307777 - DNA, 1445 bp, Homo sapiens
  misc_feature (207)..(207): n is a, c, g, or t
acgtggcgtaaacaattcctctgaagctctggcggtcagtatgtaggtgataactggccgtattcagcttatgcttatcgatccatgtgtctatgtactagttcggtgtgccctactcttatcactgtgacacgaggcctggagtgtgtcgatccgagacgtacttgcacaggtgctccgaaaagtgtatggccatgatcgtacaantgatctagtaatctaactctatacaggagatcgcgcgaagtactcggcaaatcttaggtggaccaaagcattccggaaagcagctggtaaagagcttacagtggataattcatttgaatttgaaaaacgtagaaatgaacctatcaaataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaagcgattaaaagacatctttcctgcattgccatctacataatatcagatattacggatgttagattgcatctcagtgttaaatctttactgatagatgtacttaagtaaatcatgaaaattctacttgtaactatagaagtgaattgtggacgtaaaatggttgtgctatttggataatggcactaggcagcatttgtatagtaactaatggcaaaaattcatggctagtgatgtataaaataaaatattctttgcagtaaaatattccctttgttaatgttatagaaggggggatacaaaaaggaactaacaatttgtatggcagtgtcagatatttttattttagtatttcctgttttggtttatttgcatcttagaagagcataatgacattgtttgatgaagcctaattatgctggactgttttgacctggtttaacccttctgataggtagttgtggatgctggggatgagaactgaataatctttgcctggagtgacactacactctagaatttccactttggagaatactcagttccaacttgtgattcctgatagaacagactttacttttctagcccagcattgatctagaagcagaggaatcccagcgccttttaaaagttgttatgtggttttcttttaaaaagctcctgtttttggaaagtagaatttatgggtacaacgtatgttcattatttgtacataaaataaaaccatttaaaaagtaa

SEQ ID NO: 307778 - DNA, 1435 bp, Homo sapiens
aagtttcctagcatgatgctgtgtggggcgcggtcccagtcggtattcgtgaactgtggtactctagacatgtgtccatattgagattccgtggctcctgtacttatgctggttggatgctctaggcactagattcagatacagcgcccggagtggcaaaggctgatgcgtacttgatgcaaatcctagatggtacgtctgagcgttctattacatgaaagtcgtatctccttcggagtgctaagcggtaggctcgatgtcattatggggacacgccgcctgtgtaaagagcttacagtggataattcatttgaatttgaaaaacgtagaaatgaacctatcaaataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaagcgattaaaagacatctttcctgcattgccatctacataatatcagatattacggatgttagattgcatctcagtgttaaatctttactgatagatgtacttaagtaaatcatgaaaattctacttgtaactatagaagtgaattgtggacgtaaaatggttgtgctatttggataatggcactaggcagcatttgtatagtaactaatggcaaaaattcatggctagtgatgtataaaataaaatattctttgcagtaaaatattccctttgttaatgttatagaaggggggatacaaaaaggaactaacaatttgtatggcagtgtcagatatttttattttagtatttcctgttttggtttatttgcatcttagaagagcataatgacattgtttgatgaagcctaattatgctggactgttttgacctggtttaacccttctgataggtagttgtggatgctggggatgagaactgaataatctttgcctggagtgacactacactctagaatttccactttggagaatactcagttccaacttgtgattcctgatagaacagactttacttttctagcccagcattgatctagaagcagaggaatcccagcgccttttaaaagttgttatgtggttttcttttaaaaagctcctgtttttggaaagtagaatttatgggtacaacgtatgttcattatttgtacataaaataaaaccatttaaaaagtaa

SEQ ID NO: 307779 - DNA, 1382 bp, Homo sapiens
gttaacatgggtggggtgagcggcgggatcaaatgcttatcgaggacgtgtatgttgttaggggaccatgtatctgggagacgggtgatgttcgtcagtaacagattgcaagggtgtccagcagttgggcacaagtcattaaatgtcaagtatagaaagctttagaagagatgaatgcagctaggtcttcgccaagtggggtggaccagagcttgccgtaaagtagcgggtagacgaggttacaggggataattcatttgaatttgaaaaacgtagaaatgaacctatcaaataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaagcgattaaaagacatctttcctgcattgccatctacataatatcagatattacggatgttagattgcatctcagtgttaaatctttactgatagatgtacttaagtaaatcatgaaaattctacttgtaactatagaagtgaattgtggacgtaaaatggttgtgctatttggataatggcactaggcagcatttgtatagtaactaatggcaaaaattcatggctagtgatgtataaaataaaatattctttgcagtaaaatattccctttgttaatgttatagaaggggggatacaaaaaggaactaacaatttgtatggcagtgtcagatatttttattttagtatttcctgttttggtttatttgcatcttagaagagcataatgacattgtttgatgaagcctaattatgctggactgttttgacctggtttaacccttctgataggtagttgtggatgctggggatgagaactgaataatctttgcctggagtgacactacactctagaatttccactttggagaatactcagttccaacttgtgattcctgatagaacagactttacttttctagcccagcattgatctagaagcagaggaatcccagcgccttttaaaagttgttatgtggttttcttttaaaaagctcctgtttttggaaagtagaatttatgggtacaacgtatgttcattatttgtacataaaataaaaccatttaaaaagtaa

SEQ ID NO: 307780 - DNA, 1442 bp, Homo sapiens
aagacttcctactacacatctcgtggtgcgcgcggtgccgagttacgtacgtgatacatggatcactatactcgtaaccgttgtgatatctgttcgagtgacccagtcgtattgctgttactacaggcaatgatagttaggtcccggaagggataggaaggggtgtctcgaagataatatgcagaatgtaagattgtgatagatacaatctattaggaatacgtaatgcagacagtgattcgcaaagagtatagtgtgagtactcaaaagcaattgcggagaagctgctggtaaagagcttacagtggataattcatttgaatttgaaaaacgtagaaatgaacctatcaaataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaagcgattaaaagacatctttcctgcattgccatctacataatatcagatattacggatgttagattgcatctcagtgttaaatctttactgatagatgtacttaagtaaatcatgaaaattctacttgtaactatagaagtgaattgtggacgtaaaatggttgtgctatttggataatggcactaggcagcatttgtatagtaactaatggcaaaaattcatggctagtgatgtataaaataaaatattctttgcagtaaaatattccctttgttaatgttatagaaggggggatacaaaaaggaactaacaatttgtatggcagtgtcagatatttttattttagtatttcctgttttggtttatttgcatcttagaagagcataatgacattgtttgatgaagcctaattatgctggactgttttgacctggtttaacccttctgataggtagttgtggatgctggggatgagaactgaataatctttgcctggagtgacactacactctagaatttccactttggagaatactcagttccaacttgtgattcctgatagaacagactttacttttctagcccagcattgatctagaagcagaggaatcccagcgccttttaaaagttgttatgtggttttcttttaaaaagctcctgtttttggaaagtagaatttatgggtacaacgtatgttcattatttgtacataaaataaaaccatttaaaaagtaa

SEQ ID NO: 307781 - DNA, 1437 bp, Homo sapiens
gaccacacggccgccggaggcacagtcgtgttcgcatctggtctaacagacccgcgagaacgaaggacgcttgcctttttccggtcggggaagggggaagaaggtaacttccggtgacggggttgcatcacttcctctcaagcttggcgtttgtttggtggggttacacgcgggttcaacatgcgtatcgaaaagtgttatttctgttcggggcccatctatcctggacacggcatgatgttcgtccgcaacgattgcaaggtgttcagattttgcaaatctaaatgtcataaaaactttaaaaagaagcgcaatcctcgcaaagttaggtggaccaaagcattccggaaagcagctggtaaagagcttacagtgttgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaagcgattaaaagacatctttcctgcattgccatctacataatatcagatattacggatgttagattgcatctcagtgttaaatctttactgatagatgtacttaagtaaatcatgaaaattctacttgtaactatagaagtgaattgtggacgtaaaatggttgtgctatttggataatggcactaggcagcatttgtatagtaactaatggcaaaaattcatggctagtgatgtataaaataaaatattctttgcagtaaaatattccctttgttaatgttatagaaggggggatacaaaaaggaactaacaatttgtatggcagtgtcagatatttttattttagtatttcctgttttggtttatttgcatcttagaagagcataatgacattgtttgatgaagcctaattatgctggactgttttgacctggtttaacccttctgataggtagttgtggatgctggggatgagaactgaataatctttgcctggagtgacactacactctagaatttccactttggagaatactcagttccaacttgtgattcctgatagaacagactttacttttctagcccagcattgatctagaagcagaggaatcccagcgccttttaaaagttgttatgtggttttcttttaaaaagctcctgtttttggaaagtagaatttatgggtacaacgtatgttcattatttgtacataaaataaaaccatttaaaaagtaa

SEQ ID NO: 307782 - DNA, 1380 bp, Homo sapiens
  misc_feature (169)..(169): n is a, c, g, or t
ctattaccagttcgttgtgccgcgtgtgctcgagataggtaattgatgctatggttcagtagctgttgcctagggtaggtactcctgtgtcggtgactacgttgctggtcattctcacctatttaaaagaacgcccggtgcgtcacacagagtgattgctgagaccaanaatgccatactgggaagattcctgagtgtctattaggatgcgtattcctagtcgagaactagagtatgctctcatatgacgtatgcgtacagatactgtaagattatgaccctgatcatgataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaagcgattaaaagacatctttcctgcattgccatctacataatatcagatattacggatgttagattgcatctcagtgttaaatctttactgatagatgtacttaagtaaatcatgaaaattctacttgtaactatagaagtgaattgtggacgtaaaatggttgtgctatttggataatggcactaggcagcatttgtatagtaactaatggcaaaaattcatggctagtgatgtataaaataaaatattctttgcagtaaaatattccctttgttaatgttatagaaggggggatacaaaaaggaactaacaatttgtatggcagtgtcagatatttttattttagtatttcctgttttggtttatttgcatcttagaagagcataatgacattgtttgatgaagcctaattatgctggactgttttgacctggtttaacccttctgataggtagttgtggatgctggggatgagaactgaataatctttgcctggagtgacactacactctagaatttccactttggagaatactcagttccaacttgtgattcctgatagaacagactttacttttctagcccagcattgatctagaagcagaggaatcccagcgccttttaaaagttgttatgtggttttcttttaaaaagctcctgtttttggaaagtagaatttatgggtacaacgtatgttcattatttgtacataaaataaaaccatttaaaaagtaa

SEQ ID NO: 307783 - DNA, 1125 bp, Homo sapiens
aaacttgatacaatataataccagcgcgagctatggattagtactattcgcttcgacatagatggttgctaagatcatcctggaagtgcacaaagtgctgtatactgaacagtttgaagagcactgaggagctcgagaccgtgcctcgagagatatcccagatagtcatgcagagagatactcaatctggattcgatcaccctcttgcacggcgacgggcaacgctgtcggatgacaccctggtacgacagttacaagaggatgtggacatggaagatgctccttaaaaatctctgtaaccatttcttttatgtacatttgaaaatgccctttggatacttggaactgctaaattattttattttttacataaggtcacttaaatgaaaagcgattaaaagacatctttcctgcattgccatctacataatatcagatattacggatgttagattgcatctcagtgttaaatctttactgatagatgtacttaagtaaatcatgaaaattctacttgtaactatagaagtgaattgtggacgtaaaatggttgtgctatttggataatggcactaggcagcatttgtatagtaactaatggcaaaaattcatggctagtgatgtataaaataaaatattctttgcagtaaaatattccctttgttaatgttatagaaggggggatacaaaaaggaactaacaatttgtatggcagtgtcagatatttttattttagtatttcctgttttggtttatttgcatcttagaagagcataatgacattgtttgatgaagcctaattatgctggactgttttgacctggtttaacccttctgataggtagttgtggatgctggggatgagaactgaataatctttgcctggagtgacactacactctagaatttccactttggagaatactcagttccaacttgtgattcctgatagaacagactttacttttctagcccagcattgatctagaagcagaggaatcccagcgccttttaaaagttgttatgtggttttcttttaaaaagctcctgtttttggaaagtagaatttatgggtacaacgtatgttcattatttgtacataaaataaaaccatttaaaaagtaa

SEQ ID NO: 307784 - DNA, 924 bp, Homo sapiens
  misc_feature (602)..(602): n is a, c, g, or t
  misc_feature (618)..(618): n is a, c, g, or t
gaccacacggccgccggaggcacagtcgtgttcgcatctggtctaacagacccgcgagaacgaaggacgcttgcctttttccggtcggggaagggggaagaaggtaacttccggtgacggggttgcatcacttcctctcaagcttggcgtttgtttggtggggttacacgcgggttcaacatgcgtatcgaaaagtgttatttctgttcggggcccatctatcctggacacggcatgatgttcgtccgcaacgattgcaaggtgttcagattttgcaaatctaaatgtcataaaaactttaaaaagaagcgcaatcctcgcaaagttaggtggaccaaagcattccggaaagcagctggtaaagagcttacagtggataattcatttgaatttgaaaaacgtagaaatgaacctatcaaataccagcgagagctatggaataaaactattgatgcgatgaagagagttgaagaaatcaaacagaagcgccaagctaaatttataatgaacagcacagggggcatgcaagcaaacaatcaaagcagctcaagcaaagtcaggcatcttccaaagcacagtcaagccaaaaaacaattccccanaatttctttaattccngaaagccccccccctttcccttttggcccagcgccaaaagggggggaaccaccaccaccacaaaaggaggggtttctttgtgcgggggggggggacaacaacacaccaaggcggagcaacaacaccaagggggggactacactagacatacgaaaccaacttcgtgttggggggggggttcttatcacaccacccccaacatagtcgggccccacaacaaagggggtgtttcttctcacaacacccccaaaatataatgtcggcggaacgcaccggggggggggacaaccatctttttggggcggc

SEQ ID NO: 307785 - DNA, 634 bp, Homo sapiens
  misc_feature (604)..(604): n is a, c, g, or t
gaccacacggccgccggaggcacagtcgtgttcgcatctggtctaacagacccgcgagaacgaaggacgcttgcctttttccggtcggggaagggggaagaaggtaacttccggtgacggggttgcatcacttcctctcaagcttggcgtttgtttggtggggttacacgcgggttcaacatgcgtatcgaaaagtgttatttctgttcggggcccatctatcctggacacggcatgatgttcgtccgcaacgattgcaaggtgttcagattttgcaaatctaaatgtcataaaaactttaaaaagaagcgcaatcctcgcaaagttaggtggaccaaagcattccggaaagcagctggtaaagagcttacagtggataattcatttgaatttgaaaaacgtagaaatgaacctatcaaataccagcgagagctatggaataaaactatttttatgcgctggagaggggtggtggagatcaaacaaagcgcccgctttaattttttatgtccacattaggagaaaaaggagtcacaagagtgcggttttaaagaggggagagaaaaaaccctttttccccgccccttttcagggaaagggaaanaagggagggaaattggacactctcccaggg

SEQ ID NO: 307786 - DNA, 2536 bp, Homo sapiens
  misc_feature (3)..(3): n is a, c, g, or t
  misc_feature (13)..(13): n is a, c, g, or t
  misc_feature (23)..(23): n is a, c, g, or t
  misc_feature (29)..(29): n is a, c, g, or t
  misc_feature (76)..(76): n is a, c, g, or t
  misc_feature (80)..(80): n is a, c, g, or t
  misc_feature (104)..(104): n is a, c, g, or t
  misc_feature (900)..(900): n is a, c, g, or t
tancccactgatncccccccggngggatnacaggtcccaacgcttggccaccctggttaagaggccccccttccancgancaaacggccacccccggagccttnctgagggcagctctgggctttcccagctccgaagtcaatactgagatcccagatgtgtccagagacatcctgaagaggctcgggggtggaggagccttagtgtgtccacaaagggactcctgaaactgactgagagccagtggatttgccagcagtctgagcttctaccgagtcttcccccacctcaatccctgttgctatggagactaccaatggaacggagacctggtatgagagcctgcatgccgtgctgaaggctctaaatgccactcttcacagcaatttgctctgccggccagggccagggctggggccagacaaccagactgaagagaggcgggccagcctacctggccgtgatgacaactcctacatgtacattctctttgtcatgtttctatttgctgtaactgtgggcagcctcatcctgggatacacccgctcccgcaaagtggacaagcgtagtgacccctatcatgtgtatatcaagaaccgtgtgtctatgatctaacacgagagggctgggacggtggaagaccaagacacctggggattgcgtctggggcctccagaactctgctgtggactgcatcaggtctcagtgtccctatctgtaagatcaacaagaaacacggttaagggaggtcgtcactggggtgggagaagaggggctggtagaccgaagccttgtgcataaggattttttcccaggaaaagatagactttataaacagtgggagcccatgaacaaacatataaaagtagcaacagataatgaccaataactggttcagtngctggagtattaggggcctggggattggagaacggagaagaagttgtagcagagggaaatgagacaggaagatgctctggggacacattttttatgtgttatcttcagccatgagaagcagtgatgactatcccatatcacagatatgatttaccaccaccaccctgcccccgctcccgtgaagaaagcagggcaagtgctgtgctgcccatttgggcctgcatagtgccatgattggaacccaggaactctggtctccttgcctagtgcttttcaaaactctgtgctacacaggagtggatccaggcctgaaggtcatacaattctggggactctctttaagaaaaagaattctaaaatatcttacttttgcaaacattatgaaaatatactgccacattaatatgttgctagggcccctgctaggaccttaagaaggagctcatgtgagtcaggaccctgaatgttaggcctcgttagctctatggttcatatgcttcttgaaccaagtcacagggcacttcccagccacattgccaggcaacaggactaaactacctccaaagcaagcagtcttttcagttttgactgagtgatgtgagaaacttcttttcttttcttttcttttttttttttgaggcagtctccctatgtcacccaggctgtgttgcagtgagccaagatcacaccactgcactccagcctgggtgacagagcaaggctctgtctcaaaagaaaaacaaaaacaaaaacaaaaaagactgatatcgcacctaaattattattatattaaaagaagcagagtatgagagacaggtacatggtccagtaggaagagaagcagccctgattctaccacttaaggtgatgtatgatcttaggctggacacttctctccctcatccgttttcctcttcaacataatgaaatagacttgaaagtctctaaggctctatcagttctgacattctaggcttcatatacattaagttgagccatatgtaatcactgtgtttgtaggttagaaacagctgagtatcgtagtttcatatatggttccagctaatacatgcaatgtggctggtgaacacttctgaattcagaaactatcccagatctcagctagaaccatccactgttctgtttgtccagtttcaacttaagggatctccatgcggtccctggaagtacccattgaaacctgcgtatttgtgtatagcagaactctgaaataatattctgatagcagttatctctgaggaattgggttataggtgattttccctttccgcatgataaatttatgtaatatttgactgacttgaccgtaagtatgttacttgtataataaaaggaaaaaaggtacttctattttgaaaaaataaaaataaaagcctttgggttcttgaatggaggatcatggaacacatttgctgccatatgcagttatgttgatgctctgcaaacctgtgctgagccctgttgctcaagcccttcctcatctcttcttgagggagaaggtggagacttccttaaggagatgtgacatatgggaagacaacagattcagaaatttacgtggataggactttagacaccacccagcccaaacttccaaataaaatatggaacgcaa

SEQ ID NO: 307787 - DNA, 2686 bp, Homo sapiens
  misc_feature (1050)..(1050): n is a, c, g, or t
tcacccagtgaagacactgtaagtctggaggtaggggacagcaatcagaggccctttggtcactgcacagttcctttaactgcaaccctaggctggcctgacccagctgctgcaggaaggggaggggccatgggagggggtcagagcccacagcaggactgttgcataatccttggggcctggccttgggcaatccaccctggttctgaagtttgtgctttgtgtctggttccttccttttctgccttctctcctgctttctagctctgggctttcccagctccgaagtcaatactgagatcccagatgtgtccagagacatcctgaagaggctcgggggtggaggagccttagtgtgtccacaaagggactcctgaaactgactgagagccagtggatttgccagcagtctgagcttctaccgagtcttcccccacctcaatccctgttgctatggagactaccaatggaacggagacctggtatgagagcctgcatgccgtgctgaaggctctaaatgccactcttcacagcaatttgctctgccggccagggccagggctggggccagacaaccagactgaagagaggcgggccagcctacctggccgtgatgacaactcctacatgtacattctctttgtcatgtttctatttgctgtaactgtgggcagcctcatcctgggatacacccgctcccgcaaagtggacaagcgtagtgacccctatcatgtgtatatcaagaaccgtgtgtctatgatctaacacgagagggctgggacggtggaagaccaagacacctggggattgcgtctggggcctccagaactctgctgtggactgcatcaggtctcagtgtccctatctgtaagatcaacaagaaacacggttaagggaggtcgtcactggggtgggagaagaggggctggtagaccgaagccttgtgcataaggattttttcccaggaaaagatagactttataaacagtgggagcccatgaacaaacatataaaagtagcaacagataatgaccaataactggttcagtngctggagtattaggggcctggggattggagaacggagaagaagttgtagcagagggaaatgagacaggaagatgctctggggacacattttttatgtgttatcttcagccatgagaagcagtgatgactatcccatatcacagatatgatttaccaccaccaccctgcccccgctcccgtgaagaaagcagggcaagtgctgtgctgcccatttgggcctgcatagtgccatgattggaacccaggaactctggtctccttgcctagtgcttttcaaaactctgtgctacacaggagtggatccaggcctgaaggtcatacaattctggggactctctttaagaaaaagaattctaaaatatcttacttttgcaaacattatgaaaatatactgccacattaatatgttgctagggcccctgctaggaccttaagaaggagctcatgtgagtcaggaccctgaatgttaggcctcgttagctctatggttcatatgcttcttgaaccaagtcacagggcacttcccagccacattgccaggcaacaggactaaactacctccaaagcaagcagtcttttcagttttgactgagtgatgtgagaaacttcttttcttttcttttcttttttttttttgaggcagtctccctatgtcacccaggctgtgttgcagtgagccaagatcacaccactgcactccagcctgggtgacagagcaaggctctgtctcaaaagaaaaacaaaaacaaaaacaaaaaagactgatatcgcacctaaattattattatattaaaagaagcagagtatgagagacaggtacatggtccagtaggaagagaagcagccctgattctaccacttaaggtgatgtatgatcttaggctggacacttctctccctcatccgttttcctcttcaacataatgaaatagacttgaaagtctctaaggctctatcagttctgacattctaggcttcatatacattaagttgagccatatgtaatcactgtgtttgtaggttagaaacagctgagtatcgtagtttcatatatggttccagctaatacatgcaatgtggctggtgaacacttctgaattcagaaactatcccagatctcagctagaaccatccactgttctgtttgtccagtttcaacttaagggatctccatgcggtccctggaagtacccattgaaacctgcgtatttgtgtatagcagaactctgaaataatattctgatagcagttatctctgaggaattgggttataggtgattttccctttccgcatgataaatttatgtaatatttgactgacttgaccgtaagtatgttacttgtataataaaaggaaaaaaggtacttctattttgaaaaaataaaaataaaagcctttgggttcttgaatggaggatcatggaacacatttgctgccatatgcagttatgttgatgctctgcaaacctgtgctgagccctgttgctcaagcccttcctcatctcttcttgagggagaaggtggagacttccttaaggagatgtgacatatgggaagacaacagattcagaaatttacgtggataggactttagacaccacccagcccaaacttccaaataaaatatggaacgcaa

SEQ ID NO: 307788 - DNA, 2308 bp, Homo sapiens
  misc_feature (1050)..(1050): n is a, c, g, or t
tcacccagtgaagacactgtaagtctggaggtaggggacagcaatcagaggccctttggtcactgcacagttcctttaactgcaaccctaggctggcctgacccagctgctgcaggaaggggaggggccatgggagggggtcagagcccacagcaggactgttgcataatccttggggcctggccttgggcaatccaccctggttctgaagtttgtgctttgtgtctggttccttccttttctgccttctctcctgctttctagctctgggctttcccagctccgaagtcaatactgagatcccagatgtgtccagagacatcctgaagaggctcgggggtggaggagccttagtgtgtccacaaagggactcctgaaactgactgagagccagtggatttgccagcagtctgagcttctaccgagtcttcccccacctcaatccctgttgctatggagactaccaatggaacggagacctggtatgagagcctgcatgccgtgctgaaggctctaaatgccactcttcacagcaatttgctctgccggccagggccagggctggggccagacaaccagactgaagagaggcgggccagcctacctggccgtgatgacaactcctacatgtacattctctttgtcatgtttctatttgctgtaactgtgggcagcctcatcctgggatacacccgctcccgcaaagtggacaagcgtagtgacccctatcatgtgtatatcaagaaccgtgtgtctatgatctaacacgagagggctgggacggtggaagaccaagacacctggggattgcgtctggggcctccagaactctgctgtggactgcatcaggtctcagtgtccctatctgtaagatcaacaagaaacacggttaagggaggtcgtcactggggtgggagaagaggggctggtagaccgaagccttgtgcataaggattttttcccaggaaaagatagactttataaacagtgggagcccatgaacaaacatataaaagtagcaacagataatgaccaataactggttcagtngctggagtattaggggcctggggattggagaacggagaagaagttgtagcagagggaaatgagacaggaagatgctctggggacacattttttatgtgttatcttcagccatgagaagcagtgatgactatcccatatcacagatatgatttaccaccaccaccctgcccccgctcccgtgaagaaagcagggcaagtgctgtgctgcccatttgggcctgcatagtgccatgattggaacccaggaactctggtctccttgcctagtgcttttcaaaactctgtgctacacaggagtggatccaggcctgaaggtcatacaattctgggtgacagagcaaggctctgtctcaaaagaaaaacaaaaacaaaaacaaaaaagactgatatcgcacctaaattattattatattaaaagaagcagagtatgagagacaggtacatggtccagtaggaagagaagcagccctgattctaccacttaaggtgatgtatgatcttaggctggacacttctctccctcatccgttttcctcttcaacataatgaaatagacttgaaagtctctaaggctctatcagttctgacattctaggcttcatatacattaagttgagccatatgtaatcactgtgtttgtaggttagaaacagctgagtatcgtagtttcatatatggttccagctaatacatgcaatgtggctggtgaacacttctgaattcagaaactatcccagatctcagctagaaccatccactgttctgtttgtccagtttcaacttaagggatctccatgcggtccctggaagtacccattgaaacctgcgtatttgtgtatagcagaactctgaaataatattctgatagcagttatctctgaggaattgggttataggtgattttccctttccgcatgataaatttatgtaatatttgactgacttgaccgtaagtatgttacttgtataataaaaggaaaaaaggtacttctattttgaaaaaataaaaataaaagcctttgggttcttgaatggaggatcatggaacacatttgctgccatatgcagttatgttgatgctctgcaaacctgtgctgagccctgttgctcaagcccttcctcatctcttcttgagggagaaggtggagacttccttaaggagatgtgacatatgggaagacaacagattcagaaatttacgtggataggactttagacaccacccagcccaaacttccaaataaaatatggaacgcaa

SEQ ID NO: 307789 - DNA, 2682 bp, Homo sapiens
  misc_feature (1046)..(1046): n is a, c, g, or t
tttataaagaaaaagaagtttaatggactcacagttccacacggctgggtaggcctcacaatcacggcagaaggcgaaggaggagcaaaggcacatcttaaacagtggcaggcaagagagcaggtgcaggggaactgccctttctaaaccatcagatctcgtgagacttattcactatcatgagaacagcatgggaaaaacccacccccatgattcagttacctcctactgggtccctcccatgacacatggggattatgggagctatgattccagatgagatttgggtggggacacagccaaaccatatcagccatgatgctaagattttacctgggatctgaagggaggaggtcatttgagctgcaggtgacagagccatcccctctctcttttcttttgccaccagagcttctaccgagtcttcccccacctcaatccctgttgctatggagactaccaatggaacggagacctggtatgagagcctgcatgccgtgctgaaggctctaaatgccactcttcacagcaatttgctctgccggccagggccagggctggggccagacaaccagactgaagagaggcgggccagcctacctggccgtgatgacaactcctacatgtacattctctttgtcatgtttctatttgctgtaactgtgggcagcctcatcctgggatacacccgctcccgcaaagtggacaagcgtagtgacccctatcatgtgtatatcaagaaccgtgtgtctatgatctaacacgagagggctgggacggtggaagaccaagacacctggggattgcgtctggggcctccagaactctgctgtggactgcatcaggtctcagtgtccctatctgtaagatcaacaagaaacacggttaagggaggtcgtcactggggtgggagaagaggggctggtagaccgaagccttgtgcataaggattttttcccaggaaaagatagactttataaacagtgggagcccatgaacaaacatataaaagtagcaacagataatgaccaataactggttcagtngctggagtattaggggcctggggattggagaacggagaagaagttgtagcagagggaaatgagacaggaagatgctctggggacacattttttatgtgttatcttcagccatgagaagcagtgatgactatcccatatcacagatatgatttaccaccaccaccctgcccccgctcccgtgaagaaagcagggcaagtgctgtgctgcccatttgggcctgcatagtgccatgattggaacccaggaactctggtctccttgcctagtgcttttcaaaactctgtgctacacaggagtggatccaggcctgaaggtcatacaattctggggactctctttaagaaaaagaattctaaaatatcttacttttgcaaacattatgaaaatatactgccacattaatatgttgctagggcccctgctaggaccttaagaaggagctcatgtgagtcaggaccctgaatgttaggcctcgttagctctatggttcatatgcttcttgaaccaagtcacagggcacttcccagccacattgccaggcaacaggactaaactacctccaaagcaagcagtcttttcagttttgactgagtgatgtgagaaacttcttttcttttcttttcttttttttttttgaggcagtctccctatgtcacccaggctgtgttgcagtgagccaagatcacaccactgcactccagcctgggtgacagagcaaggctctgtctcaaaagaaaaacaaaaacaaaaacaaaaaagactgatatcgcacctaaattattattatattaaaagaagcagagtatgagagacaggtacatggtccagtaggaagagaagcagccctgattctaccacttaaggtgatgtatgatcttaggctggacacttctctccctcatccgttttcctcttcaacataatgaaatagacttgaaagtctctaaggctctatcagttctgacattctaggcttcatatacattaagttgagccatatgtaatcactgtgtttgtaggttagaaacagctgagtatcgtagtttcatatatggttccagctaatacatgcaatgtggctggtgaacacttctgaattcagaaactatcccagatctcagctagaaccatccactgttctgtttgtccagtttcaacttaagggatctccatgcggtccctggaagtacccattgaaacctgcgtatttgtgtatagcagaactctgaaataatattctgatagcagttatctctgaggaattgggttataggtgattttccctttccgcatgataaatttatgtaatatttgactgacttgaccgtaagtatgttacttgtataataaaaggaaaaaaggtacttctattttgaaaaaataaaaataaaagcctttgggttcttgaatggaggatcatggaacacatttgctgccatatgcagttatgttgatgctctgcaaacctgtgctgagccctgttgctcaagcccttcctcatctcttcttgagggagaaggtggagacttccttaaggagatgtgacatatgggaagacaacagattcagaaatttacgtggataggactttagacaccacccagcccaaacttccaaataaaatatggaacgcaa

SEQ ID NO: 307790 - DNA, 3905 bp, Homo sapiens
cccaaacccagccactcacacatggcgggctcagcagccaccggccccgcccctcctcgtcgccgcagtcgcaactgcgtctgcggccacagggcggacagccacgcctctgcggagggcgaccggaagtgctcacgtcttcaccttccccgccacgccaccgtcctttcaggcccagcgtgcagcaggaaggaggactcttttgccgcggactcaagccggaagccgccttcctagtggagacgcgagtgggggaggagcagtccgaggggaacgtgggttgaacgttgcaactagggtggagatcaagctggaacaggagttccgatcgacccggtaccaagaaggggagtgcccgcggcagggttcattgaaaaaatccttagtgatattgacatgtctcaagtgacataaattagccaatgactcggaatgatggattctccgaagattggaaatggtttgccagtgattggaccagggactgatatagggatatcttcactccacatggtggggtatttgggaaaaaattttgattcagctaaagttccatcagatgagtattgccctgcttgtagagagaagggaaagttaaaagccttaaagacttaccgaattagttttcaagaatctatctttttgtgtgaggatctgcagtgcatctatcctttgggctctaaatcacttaataacctaatttctcctgatttggaagaatgtcacactccacataagcctcagaaaaggaagagcttagaaagcagctataaggattcacttcttttagcaaattccaaaaagactagaaattatattgctattgacggtggaaaagttttgaacagcaaacataatggagaagtatatgacgaaacctcgtcaaacttacctgatagtagtggtcaacagaatccaattaggacagctgattccttggagcggaatgagattttggaagctgatactgttgacatggctactacaaaagatcctgctacagttgatgtctctggaactggcagaccttcccctcaaaatgaaggatgtacatctaaactggaaatgccactggagagcaaatgtacatcatttccccaggctttatgtgtccagtggaaaaatgcttatgctctctgttggttagactgtatcctgtcagctttggtgcactcggaagagttaaagaacaccgtgactggactgtgctcgaaggaggaatctatattctggcggttgcttacaaaatataatcaagcaaatacacttctatataccagtcaattgagtggtgttaaagatggagattgtaaaaaacttacctcagaaatatttgcagagatagagacctgtctgaatgaagttagagatgaaatttttattagccttcagccccagcttagatgcacattaggtgatatggaaagccctgtgtttgcatttcccctgctcttaaaactagaaacccacattgaaaagctcttcctatattctttttcttgggactttgaatgttcgcagtgtggacaccaatatcaaaacaggcatatgaagagtctggtcacctttacaaatgtcatccctgagtggcacccacttaatgctgcccattttggtccatgtaacaattgcaacagtaaatcacaaataagaaaaatggtattagaaaaagtatctcccatattcatgttgcactttgtagaaggcttaccacagaatgacttgcagcactatgcatttcattttgaaggctgtctttatcagataacttctgtaattcagtatcgagcaaataatcattttataacatggattttagatgctgatggaagttggctggaatgtgatgacttaaaaggcccatgttctgaaaggcacaagaaatttgaagttcctgcttcagagatacatattgttatttgggaaagaaaaatatcccaagtgacagataaagaagctgcctgccttccacttaaaaagactaatgaccaacacgctctcagtaatgagaaaccagtatctttaacatcgtgttctgtgggtgatgctgcctcagctgaaacagcctcagtaactcaccctaaagatatatcagttgcccctcgtactctttcacaggacacagctgtaactcatggagatcatttactttcaggtccaaaaggtttggttgacaatattttacctctgacacttgaagaaactatccagaaaacagcctcagtttcacagttaaattctgaagctttcctgttagaaaataaacctgtagcagaaaatacaggaattctcaaaaccaatactttgctatcacaagaatcactaatggcttcttcagtatcagctccatgtaatgaaaagcttattcaagaccaatttgtggacataagttttccatcccaagttgtaaatacaaacatgcagtcagtacagctgaatacagaagatactgtaaatactaaatctgtgaataatactgatgctactggtcttatacagggagtgaagtcagtagaaattgagaaggacgctcagttaaaacaattccttacaccaaaaactgaacaattaaaaccagaacgtgtcacatctcaggtatctaatttgaagaaaaaagaaactacagcagattctcaaaccacaacatctaagtcattacagaatcagtctctgaaagaaaatcagaagaagccatttgtgggaagttgggttaaaggcttaataagcaggggtgcttcttttatgccactctgtgtttcagctcataatagaaacactataactgatttacaaccttcagttaaaggggtaaataattttggtggctttaaaactaaaggtataaaccagaaggccagccacgtatccaagaaagctcgtaagagtgcaagtaagcctcctcccatcagtaagccaccagcaggccctccatcgtctaatggcacagctgcccacccacatgctcatgctgcttcagaagttttggaaaagtctggaagcacctcatgtggagctcaactcaaccacagttcttatgggaatggtatttcttcagcaaaccatgaagacttggtggaaggtcagattcataaacttcgtctaaaacttcgtaaaaagctaaaggcagaaaagaagaaattagctgctcttatgtcttccccgcaaagcagaacagttcgaagtgaaaatctagaacaggtgccccaggatgggtctccaaatgattgtgaatcaatagaggacttgttaaatgagctaccatatccaattgatattgccagtgagtctgcatgcaccactgttcctggtgtttccctgtacagtagtcaaactcatgaagaaattttagcggaattattgtctcctacacctgtttcaacagagctgtcagaaaatggggaaggtgactttaggtatttgggaatgggagatagtcatatcccaccaccagtaccaagtgaattcaatgatgtttcccagaacacacatctgagacaggaccataattattgtagccccaccaagaaaaatccatgtgaagttcagccagactctctgacaaataatgcctgcgttagaacattaaacttggagagtccgatgaagactgatattttcgatgagtttttttcctcctcagcattaaatgctttagcaaatgacacattagacctacctcatttcgatgaatatctgtttgagaattattgaattaatgcttgttaacttttttcatataatatttattattattagaagaacttacaatgtgttcaggtagtgtttatacactggacttgtgtaattacttgtgtaataaccatgaacaaaatgcaaggtttaacctttggttctgcccatgaagcatgtaatctttcttacacattaaaatcactgaatgtgtt

SEQ ID NO: 307791 - DNA, 935 bp, Homo sapiens
cccaaacccagccactcacacatggcgggctcagcagccaccggccccgcccctcctcgtcgccgcagtcgcaactgcgtctgcggccacagggcggacagccacgcctctgcggagggcgaccggaagtgctcacgtcttcaccttccccgccacgccaccgtcctttcaggcccagcgtgcagcaggaaggaggactcttttgccgcggactcaagccggaagccgccttcctagtggagacgcgagtgggggaggagcagtccgaggggaacgtgggttgaacgttgcaactagggtggagatcaagctggaacaggagttccgatcgacccggtaccaagaaggggagtgcccgcggcagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaagaaggaatgccccacaagtgttaccatggcaaaacgtggaagagtctacaatgttacccagcatgctgttggcattgttgtaaacaaacaagttaagggcaagattcttgccaagagaattaagtgtgcgtattgagcacattaagcactctaagagccgagatagcttcctgaaacgtgtgaaggaaacatgatcagaaaaagaaagaagccaaagagaaaggtacctgggttcaactaaagcgccagcctgctccacccagagaagcacactttcgtgagaaccaatgggaaggagcctgagctgctggaacctattccctatgaattcatggcataataggtgttagaacaaacaaatttaaaggacctctgggctacaaaaaaaaatgaagctctcaaagaagactg

SEQ ID NO: 307792 - DNA, 4158 bp, Homo sapiens
cccaaacccagccactcacacatggcgggctcagcagccaccggccccgcccctcctcgtcgccgcagtcgcaactgcgtctgcggccacagggcggacagccacgcctctgcggagggcgaccggaagtgctcacgtcttcaccttccccgccacgccaccgtcctttcaggcccagcgtgcagcaggaaggaggactcttttgccgcggactcaagccggaagccgccttcctagtggagacgcgagtgggggaggagcagtccgaggggaacgtgggttgaacgttgcaactagggtggagatcaagctggaacaggagttccgatcgacccggtaccaagaaggggagtgcccgcggcagggttcattgaaaaaatccttagtgatattgacatgtctcaagtgacataaattagccaatgactcggaatgatggattctccgaagattggaaatggtttgccagtgattggaccagggactgatatagggatatcttcactccacatggtggggtatttgggaaaaaattttgattcagctaaagttccatcagatgagtattgccctgcttgtagagagaagggaaagttaaaagccttaaagacttaccgaattagttttcaagaatctatctttttgtgtgaggatctgcagtgcatctatcctttgggctctaaatcacttaataacctaatttctcctgatttggaagaatgtcacactccacataagcctcagaaaaggaagagcttagaaagcagctataaggattcacttcttttagcaaattccaaaaagactagaaattatattgctattgacggtggaaaagttttgaacagcaaacataatggagaagtatatgacgaaacctcgtcaaacttacctgatagtagtggtcaacagaatccaattaggacagctgattccttggagcggaatgagattttggaagctgatactgttgacatggctactacaaaagatcctgctacagttgatgtctctggaactggcagaccttcccctcaaaatgaaggatgtacatctaaactggaaatgccactggagagcaaatgtacatcatttccccaggctttatgtgtccagtggaaaaatgcttatgctctctgttggttagactgtatcctgtcagctttggtgcactcggaagagttaaagaacaccgtgactggactgtgctcgaaggaggaatctatattctggcggttgcttacaaaatataatcaagcaaatacacttctatataccagtcaattgagtggtgttaaagatggagattgtaaaaaacttacctcagaaatatttgcagagatagagacctgtctgaatgaagttagagatgaaatttttattagccttcagccccagcttagatgcacattaggtgatatggaaagccctgtgtttgcatttcccctgctcttaaaactagaaacccacattgaaaagctcttcctatattctttttcttgggactttgaatgttcgcagtgtggacaccaatatcaaaacaggcatatgaagagtctggtcacctttacaaatgtcatccctgagtggcacccacttaatgctgcccattttggtccatgtaacaattgcaacagtaaatcacaaataagaaaaatggtattagaaaaagtatctcccatattcatgttgcactttgtagaaggcttaccacagaatgacttgcagcactatgcatttcattttgaaggctgtctttatcagataacttctgtaattcagtatcgagcaaataatcattttataacatggattttagatgctgatggaagttggctggaatgtgatgacttaaaaggcccatgttctgaaaggcacaagaaatttgaagttcctgcttcagagatacatattgttatttgggaaagaaaaatatcccaagtgacagataaagaagctgcctgccttccacttaaaaagactaatgaccaacacgctctcagtaatgagaaaccagtatctttaacatcgtgttctgtgggtgatgctgcctcagctgaaacagcctcagtaactcaccctaaagatatatcagttgcccctcgtactctttcacaggacacagctgtaactcatggagatcatttactttcaggtccaaaaggtttggttgacaatattttacctctgacacttgaagaaactatccagaaaacagcctcagtttcacagttaaattctgaagctttcctgttagaaaataaacctgtagcagaaaatacaggaattctcaaaaccaatactttgctatcacaagaatcactaatggcttcttcagtatcagctccatgtaatgaaaagcttattcaagaccaatttgtggacataagttttccatcccaagttgtaaatacaaacatgcagtcagtacagctgaatacagaagatactgtaaatactaaatctgtgaataatactgatgctactggtcttatacagggagtgaagtcagtagaaattgagaaggacgctcagttaaaacaattccttacaccaaaaactgaacaattaaaaccagaacgtgtcacatctcaggtatctaatttgaagaaaaaagaaactacagcagattctcaaaccacaacatctaagtcattacagaatcagtctctgaaagaaaatcagaagaagccatttgtgggaagttgggttaaaggcttaataagcaggggtgcttcttttatgccactctgtgtttcagctcataatagaaacactataactgatttacaaccttcagttaaaggggtaaataattttggtggctttaaaactaaaggtataaaccagaaggccagccacgtatccaagaaagctcgtaagagtgcaagtaagcctcctcccatcagtaagccaccagcaggccctccatcgtctaatggcacagctgcccacccacatgctcatgctgcttcagaagttttggaaaagtctggaagcacctcatgtggagctcaactcaaccacagttcttatgggaatggtatttcttcagcaaaccatgaagacttggtggaaggtcagattcataaacttcgtctaaaacttcgtaaaaagctaaaggcagaaaagaagaaattagctgctcttatgtcttccccgcaaagcagaacagttcgaagtgaaaatctagaacaggtgccccaggatgggtctccaaatgattgtgaatcaatagaggacttgttaaatgagctaccatatccaattgatattgccagtgagtctgcatgcaccactgttcctggtgtttccctgtacagtagtcaaactcatgaagaaattttagcggaattattgtctcctacacctgtttcaacagagctgtcagaaaatggggaaggtgactttaggtatttgggaatgggagatagtcatatcccaccaccagtaccaagtgaattcaatgatgtttcccagaacacacatctgagacaggaccataattattgtagccccaccaagaaaaatccatgtgaagttcagccagactctctgacaaataatgcctgcgttagaacattaaacttggagagtccgatgaagactgatattttcgatgagtttttttcctcctcagcattaaatgctttagcaaatgacacattagacctacctcatttcgatgaatatctgtttgagaattattgaattaatgcttgttaacttttttcatataatatttattattattagaagaacttacaatgtgttcaggtagtgtttatacactggacttgtgtaattacttgtgtaataaccatgaacaaaatgcaaggtttaacctttggttctgcccatgaagcatgtaatctttcttacacattaaaatcactgaatgtgttctcctttttggtttcattttgttcttgtgagagtatgaggatttcaaaatgttaaagatgaaaagtggcgtctagtttctgacagtttgtacagttggatgcattacatttttagatttgaagttttggttatgttagtgttatgagtgatctttgtggtggttttcttcccctggaaacctgttgctcgtggcgctttgcccacggtgcccgagttcttgtcctgtgtccagatatgcagacaaatgaaggg

SEQ ID NO: 307793 - DNA, 3887 bp, Homo sapiens
cccaaacccagccactcacacatggcgggctcagcagccaccggccccgcccctcctcgtcgccgcagtcgcaactgcgtctgcggccacagggcggacagccacgcctctgcggagggcgaccggaagtgctcacgtcttcaccttccccgccacgccaccgtcctttcaggcccagcgtgcagcaggaaggaggactcttttgccgcggactcaagccggaagccgccttcctagtggagacgcgagtgggggaggagcagtccgaggggaacgtgggttgaacgttgcaactagggtggagatcaagctggaacaggagttccgatcgacccggtaccaagaaggggagtgcccgcggcagggttcattgaaaaaatccttagtgatattgacatgtctcaagtgacataaattagccaatgactcggaatgatggattctccgaagattggaaatggtttgccagtgattggaccagggactgatatagggatatcttcactccacatgaattttgattcagctaaagttccatcagatgagtattgccctgcttgtagagagaagggaaagttaaaagccttaaagacttaccgaattagttttcaagaatctatctttttgtgtgaggatctgcagtgcatctatcctttgggctctaaatcacttaataacctaatttctcctgatttggaagaatgtcacactccacataagcctcagaaaaggaagagcttagaaagcagctataaggattcacttcttttagcaaattccaaaaagactagaaattatattgctattgacggtggaaaagttttgaacagcaaacataatggagaagtatatgacgaaacctcgtcaaacttacctgatagtagtggtcaacagaatccaattaggacagctgattccttggagcggaatgagattttggaagctgatactgttgacatggctactacaaaagatcctgctacagttgatgtctctggaactggcagaccttcccctcaaaatgaaggatgtacatctaaactggaaatgccactggagagcaaatgtacatcatttccccaggctttatgtgtccagtggaaaaatgcttatgctctctgttggttagactgtatcctgtcagctttggtgcactcggaagagttaaagaacaccgtgactggactgtgctcgaaggaggaatctatattctggcggttgcttacaaaatataatcaagcaaatacacttctatataccagtcaattgagtggtgttaaagatggagattgtaaaaaacttacctcagaaatatttgcagagatagagacctgtctgaatgaagttagagatgaaatttttattagccttcagccccagcttagatgcacattaggtgatatggaaagccctgtgtttgcatttcccctgctcttaaaactagaaacccacattgaaaagctcttcctatattctttttcttgggactttgaatgttcgcagtgtggacaccaatatcaaaacaggcatatgaagagtctggtcacctttacaaatgtcatccctgagtggcacccacttaatgctgcccattttggtccatgtaacaattgcaacagtaaatcacaaataagaaaaatggtattagaaaaagtatctcccatattcatgttgcactttgtagaaggcttaccacagaatgacttgcagcactatgcatttcattttgaaggctgtctttatcagataacttctgtaattcagtatcgagcaaataatcattttataacatggattttagatgctgatggaagttggctggaatgtgatgacttaaaaggcccatgttctgaaaggcacaagaaatttgaagttcctgcttcagagatacatattgttatttgggaaagaaaaatatcccaagtgacagataaagaagctgcctgccttccacttaaaaagactaatgaccaacacgctctcagtaatgagaaaccagtatctttaacatcgtgttctgtgggtgatgctgcctcagctgaaacagcctcagtaactcaccctaaagatatatcagttgcccctcgtactctttcacaggacacagctgtaactcatggagatcatttactttcaggtccaaaaggtttggttgacaatattttacctctgacacttgaagaaactatccagaaaacagcctcagtttcacagttaaattctgaagctttcctgttagaaaataaacctgtagcagaaaatacaggaattctcaaaaccaatactttgctatcacaagaatcactaatggcttcttcagtatcagctccatgtaatgaaaagcttattcaagaccaatttgtggacataagttttccatcccaagttgtaaatacaaacatgcagtcagtacagctgaatacagaagatactgtaaatactaaatctgtgaataatactgatgctactggtcttatacagggagtgaagtcagtagaaattgagaaggacgctcagttaaaacaattccttacaccaaaaactgaacaattaaaaccagaacgtgtcacatctcaggtatctaatttgaagaaaaaagaaactacagcagattctcaaaccacaacatctaagtcattacagaatcagtctctgaaagaaaatcagaagaagccatttgtgggaagttgggttaaaggcttaataagcaggggtgcttcttttatgccactctgtgtttcagctcataatagaaacactataactgatttacaaccttcagttaaaggggtaaataattttggtggctttaaaactaaaggtataaaccagaaggccagccacgtatccaagaaagctcgtaagagtgcaagtaagcctcctcccatcagtaagccaccagcaggccctccatcgtctaatggcacagctgcccacccacatgctcatgctgcttcagaagttttggaaaagtctggaagcacctcatgtggagctcaactcaaccacagttcttatgggaatggtatttcttcagcaaaccatgaagacttggtggaaggtcagattcataaacttcgtctaaaacttcgtaaaaagctaaaggcagaaaagaagaaattagctgctcttatgtcttccccgcaaagcagaacagttcgaagtgaaaatctagaacaggtgccccaggatgggtctccaaatgattgtgaatcaatagaggacttgttaaatgagctaccatatccaattgatattgccagtgagtctgcatgcaccactgttcctggtgtttccctgtacagtagtcaaactcatgaagaaattttagcggaattattgtctcctacacctgtttcaacagagctgtcagaaaatggggaaggtgactttaggtatttgggaatgggagatagtcatatcccaccaccagtaccaagtgaattcaatgatgtttcccagaacacacatctgagacaggaccataattattgtagccccaccaagaaaaatccatgtgaagttcagccagactctctgacaaataatgcctgcgttagaacattaaacttggagagtccgatgaagactgatattttcgatgagtttttttcctcctcagcattaaatgctttagcaaatgacacattagacctacctcatttcgatgaatatctgtttgagaattattgaattaatgcttgttaacttttttcatataatatttattattattagaagaacttacaatgtgttcaggtagtgtttatacactggacttgtgtaattacttgtgtaataaccatgaacaaaatgcaaggtttaacctttggttctgcccatgaagcatgtaatctttcttacacattaaaatcactgaatgtgtt

SEQ ID NO: 307794 - DNA, 3738 bp, Homo sapiens
cccaaacccagccactcacacatggcgggctcagcagccaccggccccgcccctcctcgtcgccgcagtcgcaactgcgtctgcggccacagggcggacagccacgcctctgcggagggcgaccggaagtgctcacgtcttcaccttccccgccacgccaccgtcctttcaggcccagcgtgcagcaggaaggaggactcttttgccgcggactcaagccggaagccgccttcctagtggagacgcgagtgggggaggagcagtccgaggggaacgtgggttgaacgttgcaactagggtggagatcaagctggaacaggagttccgatcgacccggtaccaagaaggggagtgcccgcggcagaattttgattcagctaaagttccatcagatgagtattgccctgcttgtagagagaagggaaagttaaaagccttaaagacttaccgaattagttttcaagaatctatctttttgtgtgaggatctgcagtgcatctatcctttgggctctaaatcacttaataacctaatttctcctgatttggaagaatgtcacactccacataagcctcagaaaaggaagagcttagaaagcagctataaggattcacttcttttagcaaattccaaaaagactagaaattatattgctattgacggtggaaaagttttgaacagcaaacataatggagaagtatatgacgaaacctcgtcaaacttacctgatagtagtggtcaacagaatccaattaggacagctgattccttggagcggaatgagattttggaagctgatactgttgacatggctactacaaaagatcctgctacagttgatgtctctggaactggcagaccttcccctcaaaatgaaggatgtacatctaaactggaaatgccactggagagcaaatgtacatcatttccccaggctttatgtgtccagtggaaaaatgcttatgctctctgttggttagactgtatcctgtcagctttggtgcactcggaagagttaaagaacaccgtgactggactgtgctcgaaggaggaatctatattctggcggttgcttacaaaatataatcaagcaaatacacttctatataccagtcaattgagtggtgttaaagatggagattgtaaaaaacttacctcagaaatatttgcagagatagagacctgtctgaatgaagttagagatgaaatttttattagccttcagccccagcttagatgcacattaggtgatatggaaagccctgtgtttgcatttcccctgctcttaaaactagaaacccacattgaaaagctcttcctatattctttttcttgggactttgaatgttcgcagtgtggacaccaatatcaaaacaggcatatgaagagtctggtcacctttacaaatgtcatccctgagtggcacccacttaatgctgcccattttggtccatgtaacaattgcaacagtaaatcacaaataagaaaaatggtattagaaaaagtatctcccatattcatgttgcactttgtagaaggcttaccacagaatgacttgcagcactatgcatttcattttgaaggctgtctttatcagataacttctgtaattcagtatcgagcaaataatcattttataacatggattttagatgctgatggaagttggctggaatgtgatgacttaaaaggcccatgttctgaaaggcacaagaaatttgaagttcctgcttcagagatacatattgttatttgggaaagaaaaatatcccaagtgacagataaagaagctgcctgccttccacttaaaaagactaatgaccaacacgctctcagtaatgagaaaccagtatctttaacatcgtgttctgtgggtgatgctgcctcagctgaaacagcctcagtaactcaccctaaagatatatcagttgcccctcgtactctttcacaggacacagctgtaactcatggagatcatttactttcaggtccaaaaggtttggttgacaatattttacctctgacacttgaagaaactatccagaaaacagcctcagtttcacagttaaattctgaagctttcctgttagaaaataaacctgtagcagaaaatacaggaattctcaaaaccaatactttgctatcacaagaatcactaatggcttcttcagtatcagctccatgtaatgaaaagcttattcaagaccaatttgtggacataagttttccatcccaagttgtaaatacaaacatgcagtcagtacagctgaatacagaagatactgtaaatactaaatctgtgaataatactgatgctactggtcttatacagggagtgaagtcagtagaaattgagaaggacgctcagttaaaacaattccttacaccaaaaactgaacaattaaaaccagaacgtgtcacatctcaggtatctaatttgaagaaaaaagaaactacagcagattctcaaaccacaacatctaagtcattacagaatcagtctctgaaagaaaatcagaagaagccatttgtgggaagttgggttaaaggcttaataagcaggggtgcttcttttatgccactctgtgtttcagctcataatagaaacactataactgatttacaaccttcagttaaaggggtaaataattttggtggctttaaaactaaaggtataaaccagaaggccagccacgtatccaagaaagctcgtaagagtgcaagtaagcctcctcccatcagtaagccaccagcaggccctccatcgtctaatggcacagctgcccacccacatgctcatgctgcttcagaagttttggaaaagtctggaagcacctcatgtggagctcaactcaaccacagttcttatgggaatggtatttcttcagcaaaccatgaagacttggtggaaggtcagattcataaacttcgtctaaaacttcgtaaaaagctaaaggcagaaaagaagaaattagctgctcttatgtcttccccgcaaagcagaacagttcgaagtgaaaatctagaacaggtgccccaggatgggtctccaaatgattgtgaatcaatagaggacttgttaaatgagctaccatatccaattgatattgccagtgagtctgcatgcaccactgttcctggtgtttccctgtacagtagtcaaactcatgaagaaattttagcggaattattgtctcctacacctgtttcaacagagctgtcagaaaatggggaaggtgactttaggtatttgggaatgggagatagtcatatcccaccaccagtaccaagtgaattcaatgatgtttcccagaacacacatctgagacaggaccataattattgtagccccaccaagaaaaatccatgtgaagttcagccagactctctgacaaataatgcctgcgttagaacattaaacttggagagtccgatgaagactgatattttcgatgagtttttttcctcctcagcattaaatgctttagcaaatgacacattagacctacctcatttcgatgaatatctgtttgagaattattgaattaatgcttgttaacttttttcatataatatttattattattagaagaacttacaatgtgttcaggtagtgtttatacactggacttgtgtaattacttgtgtaataaccatgaacaaaatgcaaggtttaacctttggttctgcccatgaagcatgtaatctttcttacacattaaaatcactgaatgtgtt

SEQ ID NO: 307795 - DNA, 2808 bp, Homo sapiens
accaagatggctgctaagtgaaccacaggcaggagtgtagacagcatggacacattagacgaagggaagattcacgttgccagtggaacacagcaggacagcaagagagttcatgatgctactcagaatggcatgaaatttaaagcttataaattgtttctggaattttccgcttaatattttcagaccacggttgagttcagatggagattgtaaaaaacttacctcagaaatatttgcagagatagagacctgtctgaatgaagttagagatgaaatttttattagccttcagccccagcttagatgcacattaggtgatatggaaagccctgtgtttgcatttcccctgctcttaaaactagaaacccacattgaaaagctcttcctatattctttttcttgggactttgaatgttcgcagtgtggacaccaatatcaaaacaggcatatgaagagtctggtcacctttacaaatgtcatccctgagtggcacccacttaatgctgcccattttggtccatgtaacaattgcaacagtaaatcacaaataagaaaaatggtattagaaaaagtatctcccatattcatgttgcactttgtagaaggcttaccacagaatgacttgcagcactatgcatttcattttgaaggctgtctttatcagataacttctgtaattcagtatcgagcaaataatcattttataacatggattttagatgctgatggaagttggctggaatgtgatgacttaaaaggcccatgttctgaaaggcacaagaaatttgaagttcctgcttcagagatacatattgttatttgggaaagaaaaatatcccaagtgacagataaagaagctgcctgccttccacttaaaaagactaatgaccaacacgctctcagtaatgagaaaccagtatctttaacatcgtgttctgtgggtgatgctgcctcagctgaaacagcctcagtaactcaccctaaagatatatcagttgcccctcgtactctttcacaggacacagctgtaactcatggagatcatttactttcaggtccaaaaggtttggttgacaatattttacctctgacacttgaagaaactatccagaaaacagcctcagtttcacagttaaattctgaagctttcctgttagaaaataaacctgtagcagaaaatacaggaattctcaaaaccaatactttgctatcacaagaatcactaatggcttcttcagtatcagctccatgtaatgaaaagcttattcaagaccaatttgtggacataagttttccatcccaagttgtaaatacaaacatgcagtcagtacagctgaatacagaagatactgtaaatactaaatctgtgaataatactgatgctactggtcttatacagggagtgaagtcagtagaaattgagaaggacgctcagttaaaacaattccttacaccaaaaactgaacaattaaaaccagaacgtgtcacatctcaggtatctaatttgaagaaaaaagaaactacagcagattctcaaaccacaacatctaagtcattacagaatcagtctctgaaagaaaatcagaagaagccatttgtgggaagttgggttaaaggcttaataagcaggggtgcttcttttatgccactctgtgtttcagctcataatagaaacactataactgatttacaaccttcagttaaaggggtaaataattttggtggctttaaaactaaaggtataaaccagaaggccagccacgtatccaagaaagctcgtaagagtgcaagtaagcctcctcccatcagtaagccaccagcaggccctccatcgtctaatggcacagctgcccacccacatgctcatgctgcttcagaagttttggaaaagtctggaagcacctcatgtggagctcaactcaaccacagttcttatgggaatggtatttcttcagcaaaccatgaagacttggtggaaggtcagattcataaacttcgtctaaaacttcgtaaaaagctaaaggcagaaaagaagaaattagctgctcttatgtcttccccgcaaagcagaacagttcgaagtgaaaatctagaacaggtgccccaggatgggtctccaaatgattgtgaatcaatagaggacttgttaaatgagctaccatatccaattgatattgccagtgagtctgcatgcaccactgttcctggtgtttccctgtacagtagtcaaactcatgaagaaattttagcggaattattgtctcctacacctgtttcaacagagctgtcagaaaatggggaaggtgactttaggtatttgggaatgggagatagtcatatcccaccaccagtaccaagtgaattcaatgatgtttcccagaacacacatctgagacaggaccataattattgtagccccaccaagaaaaatccatgtgaagttcagccagactctctgacaaataatgcctgcgttagaacattaaacttggagagtccgatgaagactgatattttcgatgagtttttttcctcctcagcattaaatgctttagcaaatgacacattagacctacctcatttcgatgaatatctgtttgagaattattgaattaatgcttgttaacttttttcatataatatttattattattagaagaacttacaatgtgttcaggtagtgtttatacactggacttgtgtaattacttgtgtaataaccatgaacaaaatgcaaggtttaacctttggttctgcccatgaagcatgtaatctttcttacacattaaaatcactgaatgtgtt

SEQ ID NO: 307796 - DNA, 529 bp, Homo sapiens
caatgactcggaatgatggattctccgaagattggaaatggtttgccagtgattggaccagggactgatatagggatatcttcactccacatggtggggtatttgggaaaagttagtgaacttattttttgcctgagtgcaaagttttttttttttctctatttttgagacttaaattcaattttgatgttaccagttaacttctaaaaaattgtgtcttccacggaaatcttacagtaatggcgaaagattgttttaatgtgtttacctttctgtgttttattgatacatgaaagtggaaataaaacatagaccttatgatttactgttctttgaaaatatggtacataaattctcccgggtaattgatgttacttttttccttgcaaataaaattgatactattcttaacacataaaatttaatatttaaaactataacataattctttttggaataatagctgtatttaaaggcttatatgcatttcttttgtttgccatgtttaaaataccttgtcaggatactt

SEQ ID NO: 307797 - DNA, 2728 bp, Homo sapiens
ctcccacaaggcagcgcgccggctcggacgcggccggctaccgagccctttgtgagggctgtgagctgcgcctgacggtggcaccatgagcagctcaggtggggcgcccggggcgtccgccagctctgcgccgcccgcgcaggaagagggcatgacgtggtggtaccgctggctgtgtcgcctgtctggggtgctgggggcagtctcttgcgcgatctctggcctcttcaactgcatcaccatccaccctctgaacatcgcggccggcgtgtggatgatcatgaatgccttcatcttgttgctgtgtgaggcgcccttctgctgccagttcatcgagtttgcaaacacagtggcggagaaggtggaccggctgcgctcctggcagaaggctgtcttctactgcgggatggcggtcgttcccatcgtcatcagcctgaccctgaccacgctgctgggcaacgccatcgcctttgctacgggggtgctgtacggactctctgctctgggcaaaaagggcgatgcgatctcctatgccaggatccagcagcagaggcagcaggcggatgaggagaagctcgcggagaccctggagggggagctgtgaagggctgggcgcccctccctccctgtcccctcttctggctctgtgtgggtccaagtgaggcctggactgtccacgctgaggcacagcctggagaggggcctttgcacgtgtccctacacctggagtcctctgctcctttctccagactggcttaagccaggagccactggctgctggtgtgagggtctgggctgctggacttgaggcagagcctgcagcagctgtgtggacactacccagccctactcctctgctgggtgggtctgcagatctcacaccacagacagggctgcctgtgacctgctgtgacctgggagcagcttcccctggagatgctggtcctggcttgaggggaggggcaagtgggaccctgccacctgggcactgagcagagggacctcccccagctctcttagcaggtggagccccagggcctgggacagcctgccgctgccagcaacctcccactgctgcctagggtgcagcgcccactgtcaccctgccttctgaagaagcccacagggctcctaaggtgcaccccggtacctggaactgcagccttggcagtgactggacagctgggtgggggatgctccctgctggccctgggaaccttggacaggccacctcaaggcccctcggctgcccctcctccctgggcctgctggggcccctaggttctgcccatcaccccccgcccctgctggccttggtgctaaggaagtggggagagcaggctctccctggcaccgagggtgcccaccctctccctggtgtggccccgtcaacatcagccacagcccagccccattagtgggttagcgggtctgacctcagccccactcaggtgctcctgctggcctgcccaagccctgccctcagggagcttctgccttttaagaactgggcagaggccacagtcacctccccacacagagctgtccccactgccctgggtgccaggctgtccggagccaggcctacccagggaggatgcagagagctggtgcccaggatgtgcacccccatattccctctgccctgtggcctcagcccgctggcctctctgaccgtgaggctggctctcagccatcgggcaggtgcctggtcgggcctggcttagcccaggtggggcttggcagaagcgggcgggtgtggaagatattccatctggggccaaccccaggctgggcctgcgctgagcttctggagcgcaggtactgggtcttgctaagtgaactgtttcccaggaacacctctcgggcccatctgcgtctgaggctgggagtggcatctgaggccgggagtggcatctgaggccaggagtggcaggctggtgggctgggcgtggggttttctgggccctgcccagtactgccctggggacttggtgggctcctgggtcagcagcatcccacccctgggagtctggccagctgagccccagggtggcaggggcattatagcctggtggacatgtgccttcagggttcctccggggccaccttcctcaggccagtgctgggttcaaagggctgtgtgtgtgtgtgtgtgtgtgtgtgtatgtatatgtgtgtgggtgcacacatctgtcccatgtatgcagtgagacctgtctacctcccacaaggagcaagggctctgcccgccctctgctcattcctacccaggtagtgggaccccgggcccccttctgcctggcttgcctgcttctgccctttccagaggggtctcactgacagccagagacagcaggagaagggttggctgtggatcaaggaaggctgcccctgtaccctgtggggaaatggtgggtgcatggctggatgcagaggtggaaggccctgggccacaggcgagagtgggcgtgtcacctgtcccaggttcccagcaagtctgcagctgtgcagtcctggggtccctgaccctgtcgcccagggggcgtgctgtccagcaggggccctgccttgcaaggaacgtctcttccggcggctgggccgctcctgcctggtctgggctgtgtgtggcgccctttcctccttgtttgttcctctgtgttctgtgtgcgtcttaagcaataaagcgtggccgtggctcgcgtgcctgccctctgctcccttctgc

SEQ ID NO: 307798 - DNA, 811 bp, Homo sapiens
ctcccacaaggcagcgcgccggctcggacgcggccggctaccgagccctttgtgagggctgtgagctgcgcctgacggtggcaccatgagcagctcaggtggggcgcccggggcgtccgccagctctgcgccgcccgcgcaggaagagggcatgacgtggtggtaccgctggctgtgtcgcctgtctggggtgctgggggcagtctcttgcgcgatctctggcctcttcaactgcatcaccatccaccctctgaacatcgcggccggcgtgtggatgatcatgaatgccttcatcttgttgctgtgtgaggcgcccttctgctgccagttcatcgagtttgcaaacacagtggcggagaaggtggaccggctgcgctcctggcagaaggctgtcttctactgcgggtgaggggttgctgggcagggtcccgtgacacagttccccaaaaccccactgacaaaataggacccaaaagtcaggtgagggtgggcagtgtattcagttcctctctgtggaagtgtaaactgggattgcctttgtgcacagtgatttgctcatagctgccaaaacgtgccccagtggttctgcgcccaggaactcagctgtcgctgtgccgtagtcactggaaggttcagaggtatatgagcatgtgtggcagcatccgtgcagtggagagaaagtgggaagcgtctggaattttggtccgtccactgggagttgttaaccagatgatagtaggtctgtaggacatgtttctctgcagcctttccgaagagtgggttcatctagatgtcctgacgtgaaggggga

SEQ ID NO: 307799 - DNA, 2852 bp, Homo sapiens
ctcccacaaggcagcgcgccggctcggacgcggccggctaccgagccctttgtgagggctgtgagctgcgcctgacggtggcaccatgagcagctcaggtggggcgcccggggcgtccgccagctctgcgccgcccgcgcaggaagagggcatgacgtggtggtaccgctggctgtgtcgcctgtctggggtgctgggggcagtctcttgcgcgatctctggcctcttcaactgcatcaccatccaccctctgaacatcgcggccggcgtgtggatgatgaggaggataaagggaagcagaagcccaggggcttccctctaggagtgttcagttcagctggggagatgggtgtgcaggagcagctggggagtgctggagtcttcagcagaggctctccgagggcatgaatgccttcatcttgttgctgtgtgaggcgcccttctgctgccagttcatcgagtttgcaaacacagtggcggagaaggtggaccggctgcgctcctggcagaaggctgtcttctactgcgggatggcggtcgttcccatcgtcatcagcctgaccctgaccacgctgctgggcaacgccatcgcctttgctacgggggtgctgtacggactctctgctctgggcaaaaagggcgatgcgatctcctatgccaggatccagcagcagaggcagcaggcggatgaggagaagctcgcggagaccctggagggggagctgtgaagggctgggcgcccctccctccctgtcccctcttctggctctgtgtgggtccaagtgaggcctggactgtccacgctgaggcacagcctggagaggggcctttgcacgtgtccctacacctggagtcctctgctcctttctccagactggcttaagccaggagccactggctgctggtgtgagggtctgggctgctggacttgaggcagagcctgcagcagctgtgtggacactacccagccctactcctctgctgggtgggtctgcagatctcacaccacagacagggctgcctgtgacctgctgtgacctgggagcagcttcccctggagatgctggtcctggcttgaggggaggggcaagtgggaccctgccacctgggcactgagcagagggacctcccccagctctcttagcaggtggagccccagggcctgggacagcctgccgctgccagcaacctcccactgctgcctagggtgcagcgcccactgtcaccctgccttctgaagaagcccacagggctcctaaggtgcaccccggtacctggaactgcagccttggcagtgactggacagctgggtgggggatgctccctgctggccctgggaaccttggacaggccacctcaaggcccctcggctgcccctcctccctgggcctgctggggcccctaggttctgcccatcaccccccgcccctgctggccttggtgctaaggaagtggggagagcaggctctccctggcaccgagggtgcccaccctctccctggtgtggccccgtcaacatcagccacagcccagccccattagtgggttagcgggtctgacctcagccccactcaggtgctcctgctggcctgcccaagccctgccctcagggagcttctgccttttaagaactgggcagaggccacagtcacctccccacacagagctgtccccactgccctgggtgccaggctgtccggagccaggcctacccagggaggatgcagagagctggtgcccaggatgtgcacccccatattccctctgccctgtggcctcagcccgctggcctctctgaccgtgaggctggctctcagccatcgggcaggtgcctggtcgggcctggcttagcccaggtggggcttggcagaagcgggcgggtgtggaagatattccatctggggccaaccccaggctgggcctgcgctgagcttctggagcgcaggtactgggtcttgctaagtgaactgtttcccaggaacacctctcgggcccatctgcgtctgaggctgggagtggcatctgaggccgggagtggcatctgaggccaggagtggcaggctggtgggctgggcgtggggttttctgggccctgcccagtactgccctggggacttggtgggctcctgggtcagcagcatcccacccctgggagtctggccagctgagccccagggtggcaggggcattatagcctggtggacatgtgccttcagggttcctccggggccaccttcctcaggccagtgctgggttcaaagggctgtgtgtgtgtgtgtgtgtgtgtgtgtatgtatatgtgtgtgggtgcacacatctgtcccatgtatgcagtgagacctgtctacctcccacaaggagcaagggctctgcccgccctctgctcattcctacccaggtagtgggaccccgggcccccttctgcctggcttgcctgcttctgccctttccagaggggtctcactgacagccagagacagcaggagaagggttggctgtggatcaaggaaggctgcccctgtaccctgtggggaaatggtgggtgcatggctggatgcagaggtggaaggccctgggccacaggcgagagtgggcgtgtcacctgtcccaggttcccagcaagtctgcagctgtgcagtcctggggtccctgaccctgtcgcccagggggcgtgctgtccagcaggggccctgccttgcaaggaacgtctcttccggcggctgggccgctcctgcctggtctgggctgtgtgtggcgccctttcctccttgtttgttcctctgtgttctgtgtgcgtcttaagcaataaagcgtggccgtggctcgcgtgcctgccctctgctcccttctgc

SEQ ID NO: 307800 - DNA, 2602 bp, Homo sapiens
ctcccacaaggcagcgcgccggctcggacgcggccggctaccgagccctttgtgagggctgtgagctgcgcctgacggtggcaccatgagcagctcaggtggggcgcccggggcgtccgccagctctgcgccgcccgcgcaggaagagggcatgacgtggtggtaccgctggctgtgtcgcctgtctggggtgctgggggcagtctcttgcgcgatctctggcctcttcaactgcatcaccatccaccctctgaacatcgcggccggcgtgtggatgatgatggcggtcgttcccatcgtcatcagcctgaccctgaccacgctgctgggcaacgccatcgcctttgctacgggggtgctgtacggactctctgctctgggcaaaaagggcgatgcgatctcctatgccaggatccagcagcagaggcagcaggcggatgaggagaagctcgcggagaccctggagggggagctgtgaagggctgggcgcccctccctccctgtcccctcttctggctctgtgtgggtccaagtgaggcctggactgtccacgctgaggcacagcctggagaggggcctttgcacgtgtccctacacctggagtcctctgctcctttctccagactggcttaagccaggagccactggctgctggtgtgagggtctgggctgctggacttgaggcagagcctgcagcagctgtgtggacactacccagccctactcctctgctgggtgggtctgcagatctcacaccacagacagggctgcctgtgacctgctgtgacctgggagcagcttcccctggagatgctggtcctggcttgaggggaggggcaagtgggaccctgccacctgggcactgagcagagggacctcccccagctctcttagcaggtggagccccagggcctgggacagcctgccgctgccagcaacctcccactgctgcctagggtgcagcgcccactgtcaccctgccttctgaagaagcccacagggctcctaaggtgcaccccggtacctggaactgcagccttggcagtgactggacagctgggtgggggatgctccctgctggccctgggaaccttggacaggccacctcaaggcccctcggctgcccctcctccctgggcctgctggggcccctaggttctgcccatcaccccccgcccctgctggccttggtgctaaggaagtggggagagcaggctctccctggcaccgagggtgcccaccctctccctggtgtggccccgtcaacatcagccacagcccagccccattagtgggttagcgggtctgacctcagccccactcaggtgctcctgctggcctgcccaagccctgccctcagggagcttctgccttttaagaactgggcagaggccacagtcacctccccacacagagctgtccccactgccctgggtgccaggctgtccggagccaggcctacccagggaggatgcagagagctggtgcccaggatgtgcacccccatattccctctgccctgtggcctcagcccgctggcctctctgaccgtgaggctggctctcagccatcgggcaggtgcctggtcgggcctggcttagcccaggtggggcttggcagaagcgggcgggtgtggaagatattccatctggggccaaccccaggctgggcctgcgctgagcttctggagcgcaggtactgggtcttgctaagtgaactgtttcccaggaacacctctcgggcccatctgcgtctgaggctgggagtggcatctgaggccgggagtggcatctgaggccaggagtggcaggctggtgggctgggcgtggggttttctgggccctgcccagtactgccctggggacttggtgggctcctgggtcagcagcatcccacccctgggagtctggccagctgagccccagggtggcaggggcattatagcctggtggacatgtgccttcagggttcctccggggccaccttcctcaggccagtgctgggttcaaagggctgtgtgtgtgtgtgtgtgtgtgtgtgtatgtatatgtgtgtgggtgcacacatctgtcccatgtatgcagtgagacctgtctacctcccacaaggagcaagggctctgcccgccctctgctcattcctacccaggtagtgggaccccgggcccccttctgcctggcttgcctgcttctgccctttccagaggggtctcactgacagccagagacagcaggagaagggttggctgtggatcaaggaaggctgcccctgtaccctgtggggaaatggtgggtgcatggctggatgcagaggtggaaggccctgggccacaggcgagagtgggcgtgtcacctgtcccaggttcccagcaagtctgcagctgtgcagtcctggggtccctgaccctgtcgcccagggggcgtgctgtccagcaggggccctgccttgcaaggaacgtctcttccggcggctgggccgctcctgcctggtctgggctgtgtgtggcgccctttcctccttgtttgttcctctgtgttctgtgtgcgtcttaagcaataaagcgtggccgtggctcgcgtgcctgccctctgctcccttctgc

SEQ ID NO: 307801 - DNA, 2571 bp, Homo sapiens
gctggaggccaaatgctgactgcagcaggaagcacagccgagctgtcagcttgcgcgatctctggcctcttcaactgcatcaccatccaccctctgaacatcgcggccggcgtgtggatgatcatgaatgccttcatcttgttgctgtgtgaggcgcccttctgctgccagttcatcgagtttgcaaacacagtggcggagaaggtggaccggctgcgctcctggcagaaggctgtcttctactgcgggatggcggtcgttcccatcgtcatcagcctgaccctgaccacgctgctgggcaacgccatcgcctttgctacgggggtgctgtacggactctctgctctgggcaaaaagggcgatgcgatctcctatgccaggatccagcagcagaggcagcaggcggatgaggagaagctcgcggagaccctggagggggagctgtgaagggctgggcgcccctccctccctgtcccctcttctggctctgtgtgggtccaagtgaggcctggactgtccacgctgaggcacagcctggagaggggcctttgcacgtgtccctacacctggagtcctctgctcctttctccagactggcttaagccaggagccactggctgctggtgtgagggtctgggctgctggacttgaggcagagcctgcagcagctgtgtggacactacccagccctactcctctgctgggtgggtctgcagatctcacaccacagacagggctgcctgtgacctgctgtgacctgggagcagcttcccctggagatgctggtcctggcttgaggggaggggcaagtgggaccctgccacctgggcactgagcagagggacctcccccagctctcttagcaggtggagccccagggcctgggacagcctgccgctgccagcaacctcccactgctgcctagggtgcagcgcccactgtcaccctgccttctgaagaagcccacagggctcctaaggtgcaccccggtacctggaactgcagccttggcagtgactggacagctgggtgggggatgctccctgctggccctgggaaccttggacaggccacctcaaggcccctcggctgcccctcctccctgggcctgctggggcccctaggttctgcccatcaccccccgcccctgctggccttggtgctaaggaagtggggagagcaggctctccctggcaccgagggtgcccaccctctccctggtgtggccccgtcaacatcagccacagcccagccccattagtgggttagcgggtctgacctcagccccactcaggtgctcctgctggcctgcccaagccctgccctcagggagcttctgccttttaagaactgggcagaggccacagtcacctccccacacagagctgtccccactgccctgggtgccaggctgtccggagccaggcctacccagggaggatgcagagagctggtgcccaggatgtgcacccccatattccctctgccctgtggcctcagcccgctggcctctctgaccgtgaggctggctctcagccatcgggcaggtgcctggtcgggcctggcttagcccaggtggggcttggcagaagcgggcgggtgtggaagatattccatctggggccaaccccaggctgggcctgcgctgagcttctggagcgcaggtactgggtcttgctaagtgaactgtttcccaggaacacctctcgggcccatctgcgtctgaggctgggagtggcatctgaggccgggagtggcatctgaggccaggagtggcaggctggtgggctgggcgtggggttttctgggccctgcccagtactgccctggggacttggtgggctcctgggtcagcagcatcccacccctgggagtctggccagctgagccccagggtggcaggggcattatagcctggtggacatgtgccttcagggttcctccggggccaccttcctcaggccagtgctgggttcaaagggctgtgtgtgtgtgtgtgtgtgtgtgtgtatgtatatgtgtgtgggtgcacacatctgtcccatgtatgcagtgagacctgtctacctcccacaaggagcaagggctctgcccgccctctgctcattcctacccaggtagtgggaccccgggcccccttctgcctggcttgcctgcttctgccctttccagaggggtctcactgacagccagagacagcaggagaagggttggctgtggatcaaggaaggctgcccctgtaccctgtggggaaatggtgggtgcatggctggatgcagaggtggaaggccctgggccacaggcgagagtgggcgtgtcacctgtcccaggttcccagcaagtctgcagctgtgcagtcctggggtccctgaccctgtcgcccagggggcgtgctgtccagcaggggccctgccttgcaaggaacgtctcttccggcggctgggccgctcctgcctggtctgggctgtgtgtggcgccctttcctccttgtttgttcctctgtgttctgtgtgcgtcttaagcaataaagcgtggccgtggctcgcgtgcctgccctctgctcccttctgc

SEQ ID NO: 307802 - DNA, 1282 bp, Homo sapiens
ctcccacaaggcagcgcgccggctcggacgcggccggctaccgagccctttgtgagggctgtgagctgcgcctgacggtggcaccatgagcagctcaggtggggcgcccggggcgtccgccagctctgcgccgcccgcgcaggaagagggcatgacgtggtggtaccgctggctgtgtcgcctgtctggggtgctgggggcagtctcttgcgcgatctctggcctcttcaactgcatcaccatccaccctctgaacatcgcggccggcgtgtggatgatcatgaatgccttcatcttgttgctgtgtgaggcgcccttctgctgccagttcatcgagtttgcaaacacagtggcggagaaggtggaccggctgcgctcctggcagaaggctgtcttctactgcgggatggcggtcgttcccatcgtcatcagcctgaccctgaccacgctgctgggcaacgccatcgcctttgctacgggggtgctgtacggactctctgctctgggcaaaaagggcgatgcgatctcctatgccaggatccagcagcagaggcagcaggcggatgaggagaagctcgcggagaccctggagggggagctgtgaagggctgggcgcccctccctccctgtcccctcttctggctctgtgtgggtccaagtgaggcctggactgtccacgctgaggcacagcctggagaggggcctttgcacgtgtccctacacctggagtcctctgctcctttctccagactggcttaagccaggagccactggctgctggtgtgagggtctgggctgctggacttgaggcagagcctgcagcagctgtgtggacactacccagccctactcctctgctgggtgggtctgcagatctcacaccacagacagggctgcctgtgacctgctgtgacctgggagcagcttcccctggagatgctggtcctggcttgaggggaggggcaagtgggaccctgccacaacctcccactgctgcctagggtgcagcgcccactgtcaccctgccttctgaagaagcccacagggctcctaaggtgcaccccggtacctggaactgcagccttggcagtgactggacagctgggtgggggatgctcccctgccttgcaaggaacgtctcttccggcggctgggccgctcctgcctggtctgggctgtgtgtggcgccctttcctccttgtttgttcctctgtgttctgtgtgcgtcttaagcaataaagcgtggccgtggctcgcgtgcctgccctctgctcccttctgc

SEQ ID NO: 307803 - DNA, 368 bp, Homo sapiens
tgatgaaggactttctgaagctgtgtctcagttgatttttggggatccttcctgtgccctgggtgtctaggaaggatgctgggccgagtctgggaagcggggaaggatgtggtggctgtggggccggagtgcccccttgacctctgctttccccccaggatggcggtcgttcccatcgtcatcagcctgaccctgaccacgctgctgggcaacgccatcgcctttgctacgggggtgctgtacggactctctgctctgggcaaaaagtgcgtctgccaggcccagcccctgggcagggccttcctccctccgccccccgaagtccttcagtgaggaggatctgagagtggccccttttagctagtgga

SEQ ID NO: 307804 - DNA, 2351 bp, Homo sapiens
atccctagccccgccccggcgccccgggccgcggccgcctccgcgtccgcgtcgtcgtctgtgctcccggcgctgacgtgtctgggcggtcggcttccactccttcaggcgtcggcagccactagtcgtggcgagaggggcggggtggccggggctggcgctccacttggcccccgctcccggcccgccccgccgccgcggcccccggatgagggtatatattcggagcgagcgcgggacgccgatgagtggccgcgcggaaggagctggagacggtcgtagctgcggtcgcgccgagaaaggtttacaggtacatacattacacccctatttctacaaagcttggctattagagcattatgaacattaatgacctcaaactcacgttgtccaaagctgggcaagagcacctactacgtttctggaatgagcttgaagaagcccaacaggtagaactttatgcagagctccaggccatgaactttgaggagctgaacttctttttccaaaaggccattgaaggttttaaccagtcttctcaccaaaagaatgtggatgcacgaatggaacctgtgcctcgagaggtattaggcagtgctacaagggatcaagatcagctccaggcctgggaaagtgaaggacttttccagatttctcagaataaagtagcagttcttcttctagctggtgggcaggggacaagactcggcgttgcatatcctaaggggatgtatgatgttggtttgccatcccgtaagacactttttcagattcaagcagagcgtatcctgaagctacagcaggttgctgaaaaatattatggcaacaaatgcattattccatggtatataatgaccagtggcagaacaatggaatctacaaaggagttcttcaccaagcacaagtactttggtttaaaaaaagagaatgtaatcttttttcagcaaggaatgctccccgccatgagttttgatgggaaaattattttggaagagaagaacaaagtttctatggctccagatgggaatggtggtctttatcgggcacttgcagcccagaatattgtggaggatatggagcaaagaggcatttggagcattcatgtctattgtgttgacaacatattagtaaaagtggcagacccacggttcattggattttgcattcagaaaggagcagactgtggagcaaaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaatgtttatgaacctcagttgcagcaccatgtggctcaaaagaagattccttatgtggatacccaaggacagttaattaagccagacaaacccaatggaataaagatggaaaaatttgtctttgacatcttccagtttgcaaagaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccgcttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtctctgga

SEQ ID NO: 307805 - DNA, 2402 bp, Homo sapiens
atccctagccccgccccggcgccccgggccgcggccgcctccgcgtccgcgtcgtcgtctgtgctcccggcgctgacgtgtctgggcggtcggcttccactccttcaggcgtcggcagccactagtcgtggcgagaggggcggggtggccggggctggcgctccacttggcccccgctcccggcccgccccgccgccgcggcccccggatgagggtatatattcggagcgagcgcgggacgccgatgagtggccgcgcggaaggagctggagacggtcgtagctgcggtcgcgccgagaaaggtttacaggtacatacattacacccctatttctacaaagcttggctattagagcattatgaacattaatgacctcaaactcacgttgtccaaagctgggcaagagcacctactacgtttctggaatgagcttgaagaagcccaacaggtagaactttatgcagagctccaggccatgaactttgaggagctgaacttctttttccaaaaggccattgaaggttttaaccagtcttctcaccaaaagaatgtggatgcacgaatggaacctgtgcctcgagaggtattaggcagtgctacaagggatcaagatcagctccaggcctgggaaagtgaaggacttttccagatttctcagaataaagtagcagttcttcttctagctggtgggcaggggacaagactcggcgttgcatatcctaaggggatgtatgatgttggtttgccatcccgtaagacactttttcagattcaagcagagcgtatcctgaagctacagcaggttgctgaaaaatattatggcaacaaatgcattattccatggtatataatgaccagtggcagaacaatggaatctacaaaggagttcttcaccaagcacaagtactttggtttaaaaaaagagaatgtaatcttttttcagcaaggaatgctccccgccatgagttttgatgggaaaattattttggaagagaagaacaaagtttctatggctccagatgggaatggtggtctttatcgggcacttgcagcccagaatattgtggaggatatggagcaaagaggcatttggagcattcatgtctattgtgttgacaacatattagtaaaagtggcagacccacggttcattggattttgcattcagaaaggagcagactgtggagcaaaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaatgtttatgaacctcagttgcagcaccatgtggctcaaaagaagattccttatgtggatacccaaggacagttaattaagccagacaaacccaatggaataaagatggaaaaatttgtctttgacatcttccagtttgcaaagaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccgcagtgctacaaatgggaagtcagagaccatcacagctgatgtcaatcacaacttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtctctgga

SEQ ID NO: 307806 - DNA, 2164 bp, Homo sapiens
atccctagccccgccccggcgccccgggccgcggccgcctccgcgtccgcgtcgtcgtctgtgctcccggcgctgacgtgtctgggcggtcgtagctgcggtcgcgccgagaaaggtttacaggtacatacattacacccctatttctacaaagcttggctattagagcattatgaacattaatgacctcaaactcacgttgtccaaagctgggcaagagcacctactacgtttctggaatgagcttgaagaagcccaacaggtagaactttatgcagagctccaggccatgaactttgaggagctgaacttctttttccaaaaggccattgaaggttttaaccagtcttctcaccaaaagaatgtggatgcacgaatggaacctgtgcctcgagaggtattaggcagtgctacaagggatcaagatcagctccaggcctgggaaagtgaaggacttttccagatttctcagaataaagtagcagttcttcttctagctggtgggcaggggacaagactcggcgttgcatatcctaaggggatgtatgatgttggtttgccatcccgtaagacactttttcagattcaagcagagcgtatcctgaagctacagcaggttgctgaaaaatattatggcaacaaatgcattattccatggtatataatgaccagtggcagaacaatggaatctacaaaggagttcttcaccaagcacaagtactttggtttaaaaaaagagaatgtaatcttttttcagcaaggaatgctccccgccatgagttttgatgggaaaattattttggaagagaagaacaaagtttctatggctccagatgggaatggtggtctttatcgggcacttgcagcccagaatattgtggaggatatggagcaaagaggcatttggagcattcatgtctattgtgttgacaacatattagtaaaagtggcagacccacggttcattggattttgcattcagaaaggagcagactgtggagcaaaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaatgtttatgaacctcagttgcagcaccatgtggctcaaaagaagattccttatgtggatacccaaggacagttaattaagccagacaaacccaatggaataaagatggaaaaatttgtctttgacatcttccagtttgcaaagaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccgcttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtctctgga

SEQ ID NO: 307807 - DNA, 2272 bp, Homo sapiens
atccctagccccgccccggcgccccgggccgcggccgcctccgcgtccgcgtcgtcgtctgtgctcccggcgctgacgtgtctgggcggtcggcttccactccttcaggcgtcggcagccactagtcgtggcgagaggggcggggtggccggggctggcgctccacttggcccccgctcccggcccgccccgccgccgcggcccccggatgagggtatatattcggagcgagcgcgggacgccgatgagtggccgcgcggaaggagctggagacggtcgtagctgcggtcgcgccgagaaaggtttacaggtacatacattacacccctatttctacaaagcttggctattagagcattatgaacattaatgacctcaaactcacgttgtccaaagctgggcaagagcacctactacgtttctggaatgagcttgaagaagcccaacaggtagaactttatgcagagctccaggccatgaactttgaggagctgaacttctttttccaaaaggccattgaaggttttaaccagtcttctcaccaaaagaatgtggatgcacgaatggaacctgtgcctcgagaggtattaggcagtgctacaagggatcaagatcagctccaggcctgggaaagtgaaggacttttccagatttctcagaataaagtagcagttcttcttctagctggtgggcaggggacaagactcggcgttgcatatcctaaggggatgtatgatgttggtttgccatcccgtaagacactttttcagattcaagcagagcgtatcctgaagctacagcaggttgctgaaaaatattatggcaacaaatgcattattccatggtatataatgaccagtggcagaacaatggaatctacaaaggagttcttcaccaagcacaagtactttggtttaaaaaaagagaatgtaatcttttttcagcaaggaatgctccccgccatgagttttgatgggaaaattattttggaagagaagaacaaagtttctatggctccagatgggaatggtggtctttatcgggcacttgcagcccagaatattgtggaggatatggagcaaagaggcatttggagcattcatgtctattgtgttgacaacatattagtaaaagtggcagacccacggttcattggattttgcattcagaaaggagcagactgtggagcaaaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaatgtttatgaacctcagttgcagcaccatgtggctcaaaagaagattccttatgtggatacccaaggacagttaattaagccagacaaacccaatggaataaagatggaaaaatttgtctttgacatcttccagtttgcaaagaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccgcttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgcttacgttcaagtgtcggtcctctagg

SEQ ID NO: 307808 - DNA, 2037 bp, Homo sapiens
tgatccccctggacgtgggagttgtccaaagctgggcaagagcacctactacgtttctggaatgagcttgaagaagcccaacaggtagaactttatgcagagctccaggccatgaactttgaggagctgaacttctttttccaaaaggccattgaaggttttaaccagtcttctcaccaaaagaatgtggatgcacgaatggaacctgtgcctcgagaggtattaggcagtgctacaagggatcaagatcagctccaggcctgggaaagtgaaggacttttccagatttctcagaataaagtagcagttcttcttctagctggtgggcaggggacaagactcggcgttgcatatcctaaggggatgtatgatgttggtttgccatcccgtaagacactttttcagattcaagcagagcgtatcctgaagctacagcaggttgctgaaaaatattatggcaacaaatgcattattccatggtatataatgaccagtggcagaacaatggaatctacaaaggagttcttcaccaagcacaagtactttggtttaaaaaaagagaatgtaatcttttttcagcaaggaatgctccccgccatgagttttgatgggaaaattattttggaagagaagaacaaagtttctatggctccagatgggaatggtggtctttatcgggcacttgcagcccagaatattgtggaggatatggagcaaagaggcatttggagcattcatgtctattgtgttgacaacatattagtaaaagtggcagacccacggttcattggattttgcattcagaaaggagcagactgtggagcaaaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaatgtttatgaacctcagttgcagcaccatgtggctcaaaagaagattccttatgtggatacccaaggacagttaattaagccagacaaacccaatggaataaagatggaaaaatttgtctttgacatcttccagtttgcaaagaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccgcagtgctacaaatgggaagtcagagaccatcacagctgatgtcaatcacaacttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtctctgga

SEQ ID NO: 307809 - DNA, 2019 bp, Homo sapiens
atccctagccccgccccggcgccccgggccgcggccgcctccgcgtccgcgtcgtcgtctgtgctcccggcgctgacgtgtctgggcggtcggcttccactccttcaggcgtcggcagccactagtcgtggcgagaggggcggggtggccggggctggcgctccacttggcccccgctcccggcccgccccgccgccgcggcccccggatgagggtatatattcggagcgagcgcgggacgccgatgagtggccgcgcggaaggagctggagacggtcgtagctgcggtcgcgccgagaaaggtttacaggtacatacattacacccctatttctacaaagcttggctattagagcattatgaacattaatgacctcaaactcacgttgtccaaagctgggcaagagcacctactacgtttctggaatgagcttgaagaagcccaacaggtagaactttatgcagagctccaggccatgaactttgaggagctgaacttctttttccaaaaggccattgaaggttttaaccagtcttctcaccaaaagaatgtggatgcacgaatggaacctgtgcctcgagaggtattaggcagtgctacaagggatcaagatcagctccaggcctgggaaagtgaaggacttttccagatttctcagaataaagtagcagttcttcttctagctggtgggcaggggacaagactcggcgttgcatatcctaaggggatgtatgatgttggtttgccatcccgtaagacactttttcagattcaagcagagcgtatcctgaagctacagcaggttgctgaaaaatattatggcaacaaatgcattattccatggtatataatgaccagtggcagaacaatggaatctacaaaggagttcttcaccaagcacaagtactttggtttaaaaaaagagaatgtaatcttttttcagcaaggaatgctccccgccatgagttttgatgggaaaattattttggaagagaagaacaaagtttctatggctccagatgggaatggtggtctttatcgggcacttgcagcccagaatattgtggaggatatggagcaaagaggcatttggagcattcatgtctattgtgttgacaacatattagtaaaagtggcagacccacggttcattggattttgcattcagaaaggagcagactgtggagcaaaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaatgtttatgaacctcagttgcagcaccatgtggctcaaaagaagattccttatgtggatacccaaggacagttaattaagccagacaaacccaatggaataaagatggaaaaatttgtctttgacatcttccagtttgcaaagaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccgcttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctatcctatcagggtttctttttaactccttgatctctttattgtttgttctgtatgtgttgtacggagtacgcga

SEQ ID NO: 307810 - DNA, 1633 bp, Homo sapiens
  misc_feature (18)..(18): n is a, c, g, or t
  misc_feature (22)..(23): n is a, c, g, or t
  misc_feature (54)..(54): n is a, c, g, or t
  misc_feature (61)..(62): n is a, c, g, or t
ttttaagtaatatttttnattnngatatgattgtgatttatatttatgtaggtntaatgannatgtgctttaggggtatataatgaccagtggcagaacaatggaatctacaaaggagttcttcaccaagcacaagtactttggtttaaaaaaagagaatgtaatcttttttcagcaaggaatgctccccgccatgagttttgatgggaaaattattttggaagagaagaacaaagtttctatggctccagatgggaatggtggtctttatcgggcacttgcagcccagaatattgtggaggatatggagcaaagaggcatttggagcattcatgtctattgtgttgacaacatattagtaaaagtggcagacccacggttcattggattttgcattcagaaaggagcagactgtggagcaaaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaatgtttatgaacctcagttgcagcaccatgtggctcaaaagaagattccttatgtggatacccaaggacagttaattaagccagacaaacccaatggaataaagatggaaaaatttgtctttgacatcttccagtttgcaaagaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccgcagtgctacaaatgggaagtcagagaccatcacagctgatgtcaatcacaacttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtctctgga

SEQ ID NO: 307811 - DNA, 2189 bp, Homo sapiens
atccctagccccgccccggcgccccgggccgcggccgcctccgcgtccgcgtcgtcgtctgtgctcccggcgctgacgtgtctgggcggtcggcttccactccttcaggcgtcggcagccactagtcgtggcgagaggggcggggtggccggggctggcgctccacttggcccccgctcccggcccgccccgccgccgcggcccccggatgagggtatatattcggagcgagcgcgggacgccgatgagtggccgcgcggaaggagctggagacggtcgtagctgcggtcgcgccgagaaaggtttacaggtacatacattacacccctatttctacaaagcttggctattagagcattatgaacattaatgacctcaaactcacgttgtccaaagctgggcaagagcacctactacgtttctggaatgagcttgaagaagcccaacaggtagaactttatgcagagctccaggccatgaactttgaggagctgaacttctttttccaaaaggccattgaaggttttaaccagtcttctcaccaaaagaatgtggatgcacgaatggaacctgtgcctcgagaggtattaggcagtgctacaagggatcaagatcagctccaggcctgggaaagtgaaggacttttccagatttctcagaataaagtagcagttcttcttctagctggtgggcaggggacaagactcggcgttgcatatcctaaggggatgtatgatgttggtttgccatcccgtaagacactttttcagattcaagcagagcgtatcctgaagctacagcaggttgctgaaaaatattatggcaacaaatgcattattccatggtatataatgaccagtggcagaacaatggaatctacaaaggagttcttcaccaagcacaagtactttggtttaaaaaaagagaatgtaatcttttttcagcaaggaatgctccccgccatgagttttgatgggaaaattattttggaagagaagaacaaagtttctatggctccagatgggaatggtggtctttatcgggcacttgcagcccagaatattgtggaggatatggagcaaagaggcatttggagcattcatgtctattgtgttgacaacatattagtaaaagtggcagacccacggttcattggattttgcattcagaaaggagcagactgtggagcaaaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaatgtttatgaacctcagttgcagcaccatgtggctcaaaagaagattccttatgtggatacccaaggacagttaattaagccagacaaacccaatggaataaagatggaaaaatttgtctttgacatcttccagtttgcaaagaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccgcagtgctacaaatgggaagtcagagaccatcacagctgatgtcaatcacaacttgaaggatgccaatgatgtaccaatccaatgtgaaatctctcctcttatctcctatgctggagaagtaagtctgctttactttttcctctattcttttacaaagctttgtatatttcaaaataatgaaaaagtggattttaaatgttctcaccataaagaaaggataagtatttgaggtgatagatatgttaattggctttatttgattattcgacagtgtatatatgcattgaatcatcacattgtatctgaaaaatatatacaattattgtcaattaaaaatgaaataaggttgggcacagtggctcactcctgtaatcccagtactttgggaggctgaggcaagaggattgcttgagctcaggagtttgagaccagcctgggcaatatagtgagacctgtctttataaagaaaaaa

SEQ ID NO: 307812 - DNA, 1618 bp, Homo sapiens
  misc_feature (67)..(67): n is a, c, g, or t
  misc_feature (81)..(81): n is a, c, g, or t
gcgtcggtaacgtaatatcgatactccccgtatcgtataataaaaaaagaccactttgaggtaactngaccagtgtgttgnaacaatggaatctacaaaggagttcttcaccaagcacaagtactttggtttaaaaaaagagaatgtaatcttttttcagcaaggaatgctccccgccatgagttttgatgggaaaattattttggaagagaagaacaaagtttctatggctccagatgggaatggtggtctttatcgggcacttgcagcccagaatattgtggaggatatggagcaaagaggcatttggagcattcatgtctattgtgttgacaacatattagtaaaagtggcagacccacggttcattggattttgcattcagaaaggagcagactgtggagcaaaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaatgtttatgaacctcagttgcagcaccatgtggctcaaaagaagattccttatgtggatacccaaggacagttaattaagccagacaaacccaatggaataaagatggaaaaatttgtctttgacatcttccagtttgcaaagaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccgcagtgctacaaatgggaagtcagagaccatcacagctgatgtcaatcacaacttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtctctgga

SEQ ID NO: 307813 - DNA, 2078 bp, Homo sapiens
atccctagccccgccccggcgccccgggccgcggccgcctccgcgtccgcgtcgtcgtctgtgctcccggcgctgacgtgtctgggcggtcggcttccactccttcaggcgtcggcagccactagtcgtggcgagaggggcggggtggccggggctggcgctccacttggcccccgctcccggcccgccccgccgccgcggcccccggatgagggtatatattcggagcgagcgcgggacgccgatgagtggccgcgcggaaggagctggagacggtcgtagctgcggtcgcgccgagaaaggtttacaggtacatacattacacccctatttctacaaagcttggctattagagcattatgaacattaatgacctcaaactcacgttgtccaaagctgggcaagagcacctactacgtttctggaatgagcttgaagaagcccaacaggtagaactttatgcagagctccaggccatgaactttgaggagctgaacttctttttccaaaaggccattgaaggttttaaccagtcttctcaccaaaagaatgtggatgcacgaatggaacctgtgcctcgagaggtattaggcagtgctacaagggatcaagatcagctccaggcctgggaaagtgaaggacttttccagatttctcagaataaagtagcagttcttcttctagctggtgggcaggggacaagactcggcgttgcatatcctaaggggatgtatgatgttggtttgccatcccgtaagacactttttcagattcaagcagagcgtatcctgaagctacagcaggttgctgaaaaatattatggcaacaaatgcattattccatggtatataatgaccagtggcagaacaatggaatctacaaaggagttcttcaccaagcacaagtactttggtttaaaaaaagagaatgtaatcttttttcagcaaggaatgctccccgccatgagttttgatgggaaaattattttggaagagaagaacaaagtttctatggctccagatgggaatggtggtctttatcgggcacttgcagcccagaatattgtggaggatatggagcaaagaggcatttggagcattcatgtctattgtgttgacaacatattagtaaaagtggcagacccacggttcattggattttgcattcagaaaggagcagactgtggagcaaaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaatgtttatgaacctcagttgcagcaccatgtggctcaaaagaagattccttatgtggatacccaaggacagttaattaagccagacaaacccaatggaataaagatggaaaaatttgtctttgacatcttccagtttgcaaagaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccgcagtgctacaaatgggaagtcagagaccatcacagctgatgtcaatcacaagtaaatataccagcctgcctacagtgcatggtgatggggctgtgcttccctccatactaactggcatcgtagtttagtgctctgccttttgggggtctggagggaggatggttgaaactttggtgtgggtgcactgcttacttggtggcaggtatctctctggatgacactaactcagaatcttgttgcatgctggaaatggagagcatgctttactaaagaatctgaccacaggtgttagagctggaactgacagattttcagatgataggtaagatccagagcaggttacaggtcagggagaacacat

SEQ ID NO: 307814 - DNA, 1264 bp, Homo sapiens
ggttgctctagaggtccctgatggcatttagacaggagcagactgtggagcaaaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaatgtttatgaacctcagttgcagcaccatgtggctcaaaagaagattccttatgtggatacccaaggacagttaattaagccagacaaacccaatggaataaagatggaaaaatttgtctttgacatcttccagtttgcaaagaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccgcagtgctacaaatgggaagtcagagaccatcacagctgatgtcaatcacaacttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtctctgga

SEQ ID NO: 307815 - DNA, 1417 bp, Homo sapiens
tttaaaaagttaatatgcattactttagaatatcaactccagttccaaaatatttcccattctatgcccatttgtagctgtgttactgtttcatcccatagtaacttaatgcgttttttaatgtaccatatatacagttttaaggcatttgtaatgaatacagttttaatgcacacgtaccacagttttagtggagactgttatttgatttttttttaaatataaagagatgattgggggaaagctattcatttactatttaaatatgaactgaaacttaaatgctcttcactttgaaaatcttagtattggttgttgacacatttgctcctgaatgttgtaagattttctggcattttaaatctggaacgtgattatatcttttctcctcctgcttcttagtgtttatgaacctcagttgcagcaccatgtggctcaaaagaagattccttatgtggatacccaaggacagttaattaagccagacaaacccaatggaataaagatggaaaaatttgtctttgacatcttccagtttgcaaagaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccgcagtgctacaaatgggaagtcagagaccatcacagctgatgtcaatcacaacttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtctctgga

SEQ ID NO: 307816 - DNA, 1824 bp, Homo sapiens
atccctagccccgccccggcgccccgggccgcggccgcctccgcgtccgcgtcgtcgtctgtgctcccggcgctgacgtgtctgggcggtcggcttccactccttcaggcgtcggcagccactagtcgtggcgagaggggcggggtggccggggctggcgctccacttggcccccgctcccggcccgccccgccgccgcggcccccggatgagggtatatattcggagcgagcgcgggacgccgatgagtggccgcgcggaaggagctggagacggtcgtagctgcggtcgcgccgagaaaggtttacaggtacatacattacacccctatttctacaaagcttggctattagagcattatgaacattaatgacctcaaactcacgttgtccaaagctgggcaagagcacctactacgtttctggaatgagcttgaagaagcccaacaggtagaactttatgcagagctccaggccatgaactttgaggagctgaacttctttttccaaaaggccattgaaggttttaaccagtcttctcaccaaaagaatgtggatgcacgaatggaacctgtgcctcgagaggtattaggcagtgctacaagggatcaagatcagctccaggcctgggaaagtgaaggacttttccagatttctcagaataaagtagcagttcttcttctagctggtgggcaggggacaagactcggcgttgcatatcctaaggggatgtatgatgttggtttgccatcccgtaagacactttttcagattcaagcagagcgtatcctgaagctacagcaggttgctgaaaaatattatggcaacaaatgcattattccatggtatataatgaccagtggcagaacaatggaatctacaaaggagttcttcaccaagcacaagtactttggtttaaaaaaagagaatgtaatcttttttcagcaaggaatgctccccgccatgagttttgatgggaaaattattttggaagagaagaacaaagtttctatggctccagatgggaatggtggtctttatcgggcacttgcagcccagaatattgtggaggatatggagcaaagaggcatttggagcattcatgtctattgtgttgacaacatattagtaaaagtggcagacccacggttcattggattttgcattcagaaaggagcagactgtggagcaaaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaagtatgggcaagatgggggccttttaaaattatatttattgttaatcagaaactaagacacttgagagggatgcagacaccccaagtccatatcccacagaattcatctttcctgaggatcacttatcaaatggacatttatctcatgttgtgattgtttttagtaagatgtattgtaaggtgggaatcatcggagcccattccccagcgcattaatgggaggccaaagcatttctcccttctcaccctcccacccccaactatgtgctaggttctgttgaagcaaagcataagaaatgaaactttctttaccacagctgtgagctttttaaaaatacagatgttcaccttacaccaactgaattagaatttcaggaggtgggttcggggcatctatatttttagaaagctgcccacaaagttctaattcagctgatt

SEQ ID NO: 307817 - DNA, 1211 bp, Homo sapiens
ggttgctctagaggtccctgatggcatttagacaggagcagactgtggagcaaaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaatgtttatgaacctcagttgcagcaccatgtggctcaaaagaagattccttatgtggatacccaaggacagttaattaagccagacaaacccaatggaataaagatggatattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccgcagtgctacaaatgggaagtcagagaccatcacagctgatgtcaatcacaacttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtctctgga

SEQ ID NO: 307818 - DNA, 976 bp, Homo sapiens
cttatgtggatacccaaggaatcttcttttgagccacatggtgctgcaactgaagattccttatgtggatacccaaggacagttaattaagccagacaaacccaatggaataaagatggaaaaatttgtctttgacatcttccagtttgcaaagaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccgcttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtctctgga

SEQ ID NO: 307819 - DNA, 1185 bp, Homo sapiens
gtgattattatgactgagaaactgaattttaaattttaaattagttttaaaaattttaattaaatttaagtagccctgtgcagctattggcttctgtattggatagtacagctttagaatgtttgtcaacattaatagtaccaaggtagtggtgaagattaaaatgcaatatgaaggcttcagagcacctagcattgggcttggcatatagtatatacctagtaagtagtcacctttttatcaaattgaaacttggaaatggttaaaaatgagatgtatgtaaggggacagtgtgtaaaaactagtgaagtgctgtaaagagctaccagtaattattggcacttgccccaaatagtgtccttctgacctgagaatttcatattaacttaatcctcagggaatttagtgatcatcagggtagcatctattccatttgtttaactggaagaattatctgcaagcttctcagaggaaagttatggtttgtacttttgctctggcaagtaacatgggaagcaaagtctttaacacatacttgttttttttcttagcttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtctctgga

SEQ ID NO: 307820 - DNA, 432 bp, Homo sapiens
tgtcgaggatcccgacacttgaaacgtcaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtctctgga

SEQ ID NO: 307821 - DNA, 381 bp, Homo sapiens
atccctagccccgccccggcgccccgggccgcggccgcctccgcgtccgcgtcgtcgtctgtgctcccggcgctgacgtgtctgggcggtcggcttccactccttcaggcgtcggcagccactagtcgtggcgagaggggcggggtggccggggctggcgctccacttggcccccgctcccggcccgccccgccgccgcggcccccggatgagggtatatattcggagcgagcgcgggacgccgatgagtggccgcgcggaaggagctggagacggtcgtagctgcggtcgcgccgagaaagaaggatggtattggagggctgagcacacgtatgctgaacatatggctgcttgaactttggcctgtcgctgtgtattccg

SEQ ID NO: 307822 - DNA, 345 bp, Homo sapiens
tcagctccaggcctgggaaagtgaaggtactgggcatgtacatatttcttactgaagtttatttgagatatactaaaattgttcaggtagctggatcatgtcactaatattttgattcatactacattaaaccaggtgacctagcagaaagtgacaaaattgtctttttatttttgatgctccatttaaggcttctctcattcaagtcttaatttgcctccagtctctttccctcctcaatttccatacttctgctagatttcttttcctgaagcacaagttaaatacttaagtttaagctggcttaattttttttttttttaagacagagtctcactctgttgc

SEQ ID NO: 307823 - DNA, 748 bp, Homo sapiens
tgagaaagggtctcgctcttgtcacaaaggctgcaatgcaatgagcctgcacccagccaataaaatttatttttaaaaacatttttcaaaattgaggataagtaaagcacaagaatgaagaacagtatgaagtctttcccctagattatttcatggaaatctcaccacaatcttagtaaaaatgatagcctatttttttttaaaaaaggtcgagacaatagtccaaagacactttactaataaacggaggaacccaaatatttctgcccctaaatccatggctcatgttactacaccattttcttttccattctagaatgaaaaccaattatgaaaaaaagtggtagagaggaaagaggaacagtaagggggagaaatttattaacctataggtttacatgatcaaagtagttaatgaaaacaaaatgtggaatagagccattaaaaaaaaaaactaactgcaaacttggatcactgtaatcacactgattaaacagacccattctaatctgaaccgtcctaatcacagcagtcctacttctcctatctctcccagtcctagctgctggcatcactatactactaacagaccgcaacctcaacaccaccttcttcgaccccgccgggaagaagaaaccccattctataccaacacctattctgattttcgggtcacccctgaaatttatattccttatcctgccaaggcttcggaataatctcccatattggtaacttactactcccg

SEQ ID NO: 307824 - DNA, 542 bp, Homo sapiens
gctcacacttgatagggcaggaattgcaatcccctctctgtgagcgcagattctccaccaaggcccactgtgggttcacggtcaaagctggctaccttggggttaccatgggtgagttctttgggaagccttggagaacctccccaccaggagatttggctctggctcaacctctacctataaaaagagtggagcacatataattaccttttatgagtttatttaaaccttgagtaacatccaccctacaaacccttgttttgtcaaactgcaggggtgcaagaatgcaggttgcttctttgcccccccttttctccatcctggccttgctttttcttcatgttcacagaagcctagggaaaatcaacaaactctctttcagagcagaagtctaaactggggtaacagtctcttattgcatacactcaaatcactataaatggctcagattgagcttccttccccactggactttgaaaggataagtggacatcgtggactcactctattccagcctgggcaacacagcgagacaatttttt

SEQ ID NO: 307825 - DNA, 2699 bp, Homo sapiens
ctcttccacatcaccttggtgtctccctaaataaaaccagccctccttatcgcctggaaaaaatcaagagctagagtttgaatgggttttatataaacactcacccctgtcagcgtgcggctgggctctcaggataaactcacagcatctggcgcgatgcttgccttgcgttctctcccctgaacgtcaaggtttaagcagagcccgaggactgggagctcttctctgaaattcgatcaacctgaagccagttgcggaactgcacggggtcccgatggacctcaaggaaagccccagtgagggcagcctgcaaccttctagcatccagatctttgccaacacctccaccctccatggcatccgccacatcttcgtgtatgggccgctgaccatccggcgtgtgctgtgggcagtggccttcgtgggctctctgggcctgctgctggtggagagctctgagagggtgtcctactacttctcctaccagcatgtcactaaggtggacgaagtggtggctcaaagcctggtcttcccagctgtgaccctctgtaacctcaatggcttccggttctccaggctcaccaccaacgacctgtaccatgctggggagctgctggccctgctggatgtcaacctgcagatcccggacccccatctggctgacccctccgtgctggaggccctgcggcagaaggccaacttcaagcactacaaacccaagcagttcagcatgctggagttcctgcaccgtgtgggccatgacctgaaggatatgatgctctactgcaagttcaaagggcaggagtgcggccaccaagacttcaccacagtgtttacaaaatatgggaagtgttacatgtttaactcaggcgaggatggcaaacctctgctcaccacggtcaagggggggacaggcaacgggctggagatcatgctggacattcagcaggatgagtacctgcccatctggggagagacagaggaaacgacatttgaagcaggagtgaaagttcagatccacagtcagtctgagccacctttcatccaagagctgggctttggggtggctccagggttccagacctttgtggccacacaggagcagaggctcacatacctgcccccaccgtggggtgagtgccgatcctcagagatgggcctcgacttttttcctgtttacagcatcaccgcctgtaggattgactgtgagacccgctacattgtggaaaactgcaactgccgcatggttcacatgccaggggatgcccctttttgtacccctgagcagcacaaggagtgtgcagagcctgccctaggtctgttggcggaaaaggacagcaattactgtctctgcaggacaccctgcaacctaacccgctacaacaaagagctctccatggtgaagatccccagcaagacatcagccaagtaccttgagaagaaatttaacaaatcagaaaaatatatctcagagaacatccttgttctggatatattttttgaagctctcaattatgagacaattgaacagaagaaggcgtatgaagttgctgccttacttggtgatattggtggtcagatgggattgttcattggtgctagtatccttacaatactagagctctttgattatatttatgagctgatcaaagagaagctattagacctgcttggcaaagaggaggacgaagggagccacgatgagaatgtgagtacttgtgacacaatgccaaaccactctgaaaccatcagtcacactgtgaacgtgcccctgcagacgaccctggggaccttggaggagattgcctgctgacacccctcgagtcacccagcactccctccaaacagaccttgaggcccaagacccaggacaaggaacagcaagctcaggtgggatggccccagtgctggaaagaagcaagagccccctatgcacacattgcagactagctgcctagacctcgctccggccacgtccaacacgacgcatccttgggccccgccgtgcgtccctcttaggagagatgagtcacactctggaactgtccaagaacgaacctgccatcacatctcactgccagatgtataaagcacctgcatgctcagacttcttgtggcgccacctccacgtctgtcttgtacatgacactcctccacgcggtttccagtgtccacactgctgcccgtgcagtgggaccagattccaggtccaaagtcaccatgaggccaccctggaatcagaactgcacaatcaagagggaacccatgggactctctgctacattcagttcttgtgtcgtttgtgaaagttcttaacctgcccaaaaacccccttttccccaagctgcccatggggcttcggcgccaaaggtgacccgcgccaacctccctccccccccagtgcctgtgacggcggcacagcagccagcgggtgggggacgcctgtgttcacccatggtgcccatgtcgttcttctctccctgtgacacagcttgtacagtctgattctttttatctggggtaggggggcttttatgtttgtccgatggagatttgttttgttttgcttcattttatgcttttttattttagttttgatgttctgaggtttgctttggtttttccattttctttggcatttatttattcgtgcttcaaatcacagtcatattaaaagctggtcttgtggaaatggctga

SEQ ID NO: 307826 - DNA, 1949 bp, Homo sapiens
gagtcttgagcatccagcggaactgagcagtggtgcgccagggttgggcccttcacctggcctccgtcccccataaaatgtgtttacaaaatatgggaagtgttacatgtttaactcaggcgaggatggcaaacctctgctcaccacggtcaagggggggacaggcaacgggctggagatcatgctggacattcagcaggatgagtacctgcccatctggggagagacagaggaaacgacatttgaagcaggagtgaaagttcagatccacagtcagtctgagccacctttcatccaagagctgggctttggggtggctccagggttccagacctttgtggccacacaggagcagaggctcacatacctgcccccaccgtggggtgagtgccgatcctcagagatgggcctcgacttttttcctgtttacagcatcaccgcctgtaggattgactgtgagacccgctacattgtggaaaactgcaactgccgcatggttcacatgccaggggatgcccctttttgtacccctgagcagcacaaggagtgtgcagagcctgccctaggtctgttggcggaaaaggacagcaattactgtctctgcaggacaccctgcaacctaacccgctacaacaaagagctctccatggtgaagatccccagcaagacatcagccaagtaccttgagaagaaatttaacaaatcagaaaaatatatctcagagaacatccttgttctggatatattttttgaagctctcaattatgagacaattgaacagaagaaggcgtatgaagttgctgccttacttggtgatattggtggtcagatgggattgttcattggtgctagtatccttacaatactagagctctttgattatatttatgagctgatcaaagagaagctattagacctgcttggcaaagaggaggacgaagggagccacgatgagaatgtgagtacttgtgacacaatgccaaaccactctgaaaccatcagtcacactgtgaacgtgcccctgcagacgaccctggggaccttggaggagattgcctgctgacacccctcgagtcacccagcactccctccaaacagaccttgaggcccaagacccaggacaaggaacagcaagctcaggtgggatggccccagtgctggaaagaagcaagagccccctatgcacacattgcagactagctgcctagacctcgctccggccacgtccaacacgacgcatccttgggccccgccgtgcgtccctcttaggagagatgagtcacactctggaactgtccaagaacgaacctgccatcacatctcactgccagatgtataaagcacctgcatgctcagacttcttgtggcgccacctccacgtctgtcttgtacatgacactcctccacgcggtttccagtgtccacactgctgcccgtgcagtgggaccagattccaggtccaaagtcaccatgaggccaccctggaatcagaactgcacaatcaagagggaacccatgggactctctgctacattcagttcttgtgtcgtttgtgaaagttcttaacctgcccaaaaacccccttttccccaagctgcccatggggcttcggcgccaaaggtgacccgcgccaacctccctccccccccagtgcctgtgacggcggcacagcagccagcgggtgggggacgcctgtgttcacccatggtgcccatgtcgttcttctctccctgtgacacagcttgtacagtctgattctttttatctggggtaggggggcttttatgtttgtccgatggagatttgttttgttttgcttcattttatgcttttttattttagttttgatgttctgaggtttgctttggtttttccattttctttggcatttatttattcgtgcttcaaatcacagtcatattaaaagctggtcttgtggaaatggctga

SEQ ID NO: 307827 - DNA, 409 bp, Homo sapiens
tgtgctgagttcactgtatcctcagtggtgctctgagatttccagaggaaggaaaggttaagaggataatggtacaacactggctgtcaaaaacctttcactgattgtctgagtctaggagaagggcagcagagcctccatgggtttgaacagcaacacgacctgtacaggcccagaaacacactgtgagcacaatccgggctggaggcctgctagagagtgagccagggagcagagtgagccacaggagcccaggctggggctacatttctgatgttggcctcattagcatctttccaaacaaaccaatgtaatgcacatctattaattcattcactcaacacaattttattaagtgtctgctctgtgtcaggcaatgagttcatggagttttcactcaagtaaagga

SEQ ID NO: 307828 - DNA, 368 bp, Homo sapiens
ctgtaataatgaagaccgagtaatattagtaaacacatatatcagtgaaacagaatagagtccagaaatagtcccacacatatatggacaattaatttttggcaaaggtgcaaaagtagtctaatggaggaaggataatcatatgccaaacaaatgtgctttgacctaaacctcacaatttatatgaaacttaacaaaaaactaagtctaaatataaaacatgaaactctaaaacttttatgggaaacgtataaggaaatttatgggacttagggtaggcaaagctttcttagttgtgacgacgaaagcataattcactaaaaaagggataaatttcgttttgactttgtctaagttaaaaacttttg

SEQ ID NO: 307829 - DNA, 1514 bp, Homo sapiens
cggccgcgagtcctgcgtgatcgcgagcatgtgtgcgtgcgcgtgtttatctgaggcgcgtgcggcggccaccccagcctagtcctcttcttggtgccactggctaactaggttgagaaaccggcgccacaggcggcacacctggcccggagctggcccgctcctccccgccgagccggcgccccaacaacgcgccctctcccagtcctcacaaaggggcctagtccggcccccggctctggccgtgagggagcgctgtgggggcgcgctgccttctgcctggaagtgttgggcaggtggtgggagagcgtcaggcttgaacaacatgattttaaagcacgtgtctgtctgtcgttttttacttttagggttttggccaaattgggcgagggcacaaaataaccacttaccccttctcaccgaggaagagcgggagaaagggtatggcacagtcacaagggtgggtgaaaagatacatcaaggccttttgtaaaggcttctttgtggcggtgcctgtggcagtgactttcttggatcgggtcgcctgtgtggcaagagtagaaggagcatcgatgcagccttctttgaatcctggggggagccagtcatctgatgtggtgcttttgaaccactggaaagtgaggaattttgaagtacaccgtggtgacattgtatcattggtgtctcctaaaaacccagaacagaagatcattaagagagtgattgctcttgaaggagatattgtcagaaccataggacacaaaaaccggtatgtcaaagtcccccgtggtcacatctgggttgaaggtgatcatcatggacacagttttgacagtaattcttttgggccggtttccctaggacttctgcatgcccatgccacacatatcctgtggcccccagagcgctggcagaaattggaatctgttcttcctccagagcgcttaccagtacagagagaagaggaatgactgcatgaatctacctgagttgctggcattgggaggccagttactggaaaggaatggaaaaaagaagcctccaaaagggaaaaacttctgacaatatgatgctgtgcgagaaatatttacagcacattaaaacgatctgtattattaaataaataattttcaaatgttaaacagtattaaatggcacctgattttgtgttaaattttagttccctgttgtttaatgcccccaaaatatgcagacctttgggaatataaaaatattgcacccacatgtcttaatggggctgaatttcagattatttgttacatatacttattatattgattgttgggttttgattttggtgcttgctgctgaaataaattgaaaattaatattcaataaaaatgatgtatttgtcacttgctgttaaggtagaacaagaaggaacacatattatacacataatgatgggaattacattgtgatttgtactatctacaaaggagtaactgccagttaggaagaacagtaaacagtgatgttaaaataaaacaatg

SEQ ID NO: 307830 - DNA, 797 bp, Homo sapiens
  misc_feature (797)..(797): n is a, c, g, or t
acttcaaatggtttttgtgaggattaaaggagtttatatacaatagcacctagaaaaatgctatataagtgcttactgtatttttctttgtatttcaatggctacaaaaggtgtttactattttttttattcatcatcacttctccctgggatgttaaacctggattaaattctgctttcaagctattaataatgattcttataaaatgatctctttattgctttctttctgtttctcatggaattaaggtttccctaggacttctgcatgcccatgccacacatatcctgtggcccccagagcgctggcagaaattggaatctgttcttcctccagagcgcttaccagtacagagagaagaggaatgactgcatgaatctacctgagttgctggcattgggaggccagttactggaaaggaatggaaaaaagaagcctccaaaagggaaaaacttctgacaatatgatgctgtgcgagaaatatttacagcacattaaaacgatctgtattattaaataaataattttcaaatgttaaacagtattaaatggcacctgattttgtgttaaattttagttccctgttgtttaatgcccccaaaatatgcagacctttgggaatataaaaatattgcacccacatgtcttaatggggctgaatttcagattatttgttacatatacttattatattgattgttgggttttgattttggtgcttgctgctgaaataaattgaaaattaatattcaataaaagcctcgttggcctcagcggtggagctctgcggccggan

SEQ ID NO: 307831 - DNA, 1181 bp, Homo sapiens
  misc_feature (1180)..(1180): n is a, c, g, or t
ggggctgagctgcgcagcggggttttggccaaattgggcgagggcacaaaataaccacttaccccttctcaccgaggaagagcgggagaaagggtatggcacagtcacaagggtgggtgaaaagatacatcaaggccttttgtaaaggcttctttgtggcggtgcctgtggcagtgactttcttggatcgggtcgcctgtgtggcaagagtagaaggagcatcgatgcagccttctttgaatcctggggggagccagtcatctgatgtggtgcttttgaaccactggaaagtgaggaattttgaagtacaccgtggtgacattgtatcattggtgtctcctaaaaacccagaacagaagatcattaagagagtgattgctcttgaaggagatattgtcagagatgggagaaaactgaaaaggatatgaaacagaaacttccgaatcagtgacaagaatgaaagctttagatgataagattgtaacaatcaggtgtttaagcagcctttagtaatgtcgtatttattgtacttgctgataaatcaagaacaattgttgacattcagcaagtaaatactgtgtggcatgatgtgtctcattgtgatcgctttctttaaacaagttgtagccaggcctatacaatgtggtagccaaaatgctttgactactacattgaggaagttttctgaccctgttttctaaaaaaacttgatcctaaagtatttgtattaatgatagtacacatattaactaatctcactgaaatgaacctcagtcagttttagagcagattctaggctagcagttctcacagcatggccagaggatcccaggggatccccactgggggcctatgagattaaaactactttcctaataatactaaagtgttacttgccgtttttcactctcattctcttgtgagtgtacagtggaattttccagatatgtaatattggagttgattgaatgcaggagcagatatgagaatccagctgttttctattaagccagaaactaaaaagatttgcaaaaatgtaaaaaaaaaaaatcattatttttactatttattgtttgcttttggaaaaggactataatttttatttaaatcgtattctttttgttaacataagggtttattattggtattttaaattgaatcaataaatgaaattttaaanc

SEQ ID NO: 307832 - DNA, 899 bp, Homo sapiens
  misc_feature (870)..(870): n is a, c, g, or t
agatttacctcctcatctggctcttcatttgtggtacttttaatgcaccagtaatggtaggagaggacattgaagcaaggagacactttctgaacctctgttgccaaccgagaagagttagcctaagattgaagaagtgcatatctgaggtcaaggacaaggcgggcagtgctcaatgtcatcctttagaacagagggcaggaatcccatctggagagtggaggcaactgaaagagaggtctcctaaaaacccagaacagaagatcattaagagagtgattgctcttgaaggagatattgtcagaaccataggacacaaaaaccggtatgtcaaagtcccccgtggtcacatctgggttgaaggtgatcatcatggacacagttttgacagtaattcttttgggccggtttccctaggacttctgcatgcccatgccacacatatcctgtggcccccagagcgctggcagaaattggaatctgttcttcctccagagcgcttaccagtacagagagaagaggaatgactgcatgaatctacctgagttgctggcattgggaggccagttactggaaaggaatggaaaaaagaagcctccaaaagggaaaaacttctgacaatatgatgctgtgcgagaaatatttacagcacattaaaacgatctgtattattaaataaataattttcaaatgttaaacagtaaaaaaaaaagacagaaaaaaaacccggagacactataaagcaggaatgcgcaacacaagcggcgctagcacagttggcacggggaccataggcggttccgagaccccagctctcttggtcaaaagcggcgcaaatctggcggggaccccatatgagaggcgaataanttccagataagccgggtaaccgcgtaagg

SEQ ID NO: 307833 - DNA, 941 bp, Homo sapiens
  misc_feature (932)..(932): n is a, c, g, or t
cgccggcggagggcggggtctgcgcggggacttcccccgggctgagctgcgcagcggggttttggccaaattgggcgagggcacaaaataaccacttaccccttctcaccgaggaagagcgggagaaagggtatggcacagtcacaagggtgggtgaaaagatacatcaaggccttttgtaaaggcttctttgtggcggtgcctgtggcagtgactttcttggatcgggtcgcctgtgtggcaagagtagaaggagcatcgatgcagccttctttgaatcctggggggagccagtcatctgatgtggtgcttttgaaccactggaaagtgaggaattttgaagtacaccgtggtgacattgtatcattggtgtctcctaaaaacccagaacagaagatcattaagagagtgattgctcttgaaggagatattgtcagcaaccttgggagaatccacctgaacattcctcagagaagctgaaaattactttaaaagaagttacagcagtgcatactatgtgtggctttcctacaatgtagcaaacagaaacttggggttccagaatgttcctgaatataaacacagtaaaatttcttggataggaagtgcttcaaaaaaagatgtcattggaagataccagtgtggaaggtaagggcattggtctgaatttatttgcccatctaagcttagtttgcagaaggcataaatagggaggaactagggaaataatgggcttagtcaacaggtaatctatttaggtgaagccactatattttgcgcagataaggggtgctgagactggttacttaaaaatcgagataaatcgggggaaagaagtattggacgccatgtatggccagttcaatagggggggggaacatgagaaaaaatatggacaaacttcaattatacacaggataatatattagggnacaaaagag

SEQ ID NO: 307834 - DNA, 575 bp, Homo sapiens
cggccgcgagtcctgcgtgatcgcgagcatgtgtgcgtgcgcgtgtttatctgaggcgcgtgcggcggccaccccagcctagtcctcttcttggtgccactggctaactaggttgagaaaccggcgccacaggcggcacacctggcccggagctggcccgctcctccccgccgagccggcgccccaacaacgcgccctctcccagtcctcacaaaggggcctagtccggcccccggctctggccgtgagggagcgctgtgggggcgcgctgccttctgcctggaagtgttgggcaggtggtgggagagcgtcaggcttgaacaacatgattttaaagcacgtgtctgtctgtcgttttttacttttagggttttggccaaattgggcgagggcacaaaataaccacttaccccttctcaccgaggaagagcgggagaaagggtaagtaaggaatggtcaggggtggaaggacctaggactttatcctgagagcgagcgagagagagaagggctagatgtccagaactgctcgtggggaacttgggcccagattctaccttttcatcgggaactgg

SEQ ID NO: 307835 - DNA, 787 bp, Homo sapiens
cgccggcggagggcggggtctgcgcggggacttcccccgggctgagctgcgcagcggggttttggccaaattgggcgagggcacaaaataaccacttaccccttctcaccgaggaagagcgggagaaagggtatggcacagtcacaagggtgggtgaaaagatacatcaaggccttttgtaaaggcttctttgtggcggtgcctgtggcagtgactttcttggatcgggtcgcctgtgtggcaagagtagaaggagcatcgatgcagccttctttgaatcctggggggagccagtcatctgatgtggtgcttttgaaccactggaaagtgaggaattttgaagtacaccgtggtgacattgtatcattggttttctcctgaactgctcttggtctccatgaaggctactggcaggagcacatgagagagcagcagcacagcaagtggataaaagcacagactctggagccagcctgtctagattcaaattttatttactctatctgtgatcttggcctcattaagttatctctgttttagtttttttcctatggttaatgatagtcccaacctcatagaatagctttgaacattcagtgagttattccacatgaagcacttagaggaactattagtattcaagtgtttcataacaaagtataatcatttgacaataaataaactaatatactcatttggtaacacacacagacccacacacacacacacacatacacgtatgtcatccactgtttgcaattgtgagattatactcccagaagtaatt

SEQ ID NO: 307836 - DNA, 892 bp, Homo sapiens
cgccggcggagggcggggtctgcgcggggacttcccccgggctgagctgcgcagcggggttttggccaaattgggcgagggcacaaaataaccacttaccccttctcaccgaggaagagcgggagaaagggggaaaatatctttgcatttcttcgttggtatgctcagcctcctttaacagtggaaagtcttgaagccaccaaatgagactttcactttaattgggagaagacttgctcttggttgaatcaaaaccttcatgtactggggaaaattgtgtatgaaccagcatagctttcacataagactgacgtcattttcctatatatgagctaatttacattaagaaatagctattgtagcagaaaagactgtaatattaattttgttttagtatataaagatactaaatacctattactgaagatttaagtaatatggaaaaatataaagcataaagtgaaattcctttcattgcaaataaatactgtcatcattttggttcatattctttattatttgacctctttctatgatgatgatgataaggatgacgatgaggatgatgctgtgtgtgtataaaatttcacataaatgggttcatattaaaaatgcaattttccaacttttttggaggagaatctcaagcaatataacgatatattgttctttttaatgattgcagattactctactgtatgcatgtcataatttatttacatatttgtgaacatttggttgttttcattttttcactgcaataaaaatggtatgttgaatatcgttgatcatatctttgcatccataaaataaattcctggagtggtgtttctgcatcagaaggtatattcatgtaacattttggtacatattaccatattaaatttgtcag

SEQ ID NO: 307837 - DNA, 1116 bp, Homo sapiens
ggcatttctcctattaatgacatacatgcattcctgaaaaatctttaattctgcaaaattaaaccataaaattttagggcttataaagaaaatagggctaggaacagatcatttgaaaccagtgacattttgtaaacagagctgagaaaatagaagttgtcataaaaacgagcactattaactccctccttgcatttgcacccagcatcacatcagtcttagcttgaaaccctggttttcttcctttgttgtaggtccttaaagtcatctacttctaatacagaccaatttcatcaaagttgaaaatctgctctaggatattgatctgttgattttattctattttaaacacaggggaaaatatctttgcatttcttcgttggtatgctcagcctcctttaacagtggaaagtcttgaagccaccaaatgagactttcactttaattgggagaagacttgctcttggttgaatcaaaaccttcatgtactggggaaaattgtgtatgaaccagcatagctttcacataagactgacgtcattttcctatatatgagctaatttacattaagaaatagctattgtagcagaaaagactgtaatattaattttgttttagtatataaagatactaaatacctattactgaagatttaagtaatatggaaaaatataaagcataaagtgaaattcctttcattgcaaataaatactgtcatcattttggttcatattctttattatttgacctctttctatgatgatgatgataaggatgacgatgaggatgatgctgtgtgtgtataaaatttcacataaatgggttcatattaaaaatgcaattttccaacttttttggaggagaatctcaagcaatataacgatatattgttctttttaatgattgcagattactctactgtatgcatgtcataatttatttacatatttgtgaacatttggttgttttcattttttcactgcaataaaaatggtatgttgaatatcgttgatcatatctttgcatccataaaataaattcctggagtggtgtttctgcatcagaaggtatattcatgtaacattttggtacatattaccatattaaatttgtcag

SEQ ID NO: 307838 - DNA, 1203 bp, Homo sapiens
cgccggcggagggcggggtctgcgcggggacttcccccgggctgagctgcgcagcggggttttggccaaattgggcgagggcacaaaataaccacttaccccttctcaccgaggaagagcgggagaaagggtatggcacagtcacaagggtgggtgaaaagatacatcaaggccttttgtaaaggcttctttgtggcggtgcctgtggcagtgactttcttggatcgggtcgcctgtgtggcaagagtagaaggagcatcgatgcagccttctttgaatcctggggggagccagtcatctgatgtggtgcttttgaaccactggaaagtgaggaattttgaagtacaccgtggtgacattgtatcattggtgtctcctaaaaacccagaacagaagatcattaagagagtgattgctcttgaaggagatattgtcagaaccataggacacaaaaaccggtatgtcaaagtcccccgtggtcacatctgggttgaaggtgatcatcatggacacagttttgacagtaattcttttgggccggtttccctaggacttctgcatgcccatgccacacatatcctgtggcccccagagcgctggcagaaattggaatctgttcttcctccagagcgcttaccagtacagagagaagaggaatgactgcatgaatctacctgagttgctggcattgggaggccagttactggaaaggaatggaaaaaagaagcctccaaaagggaaaaacttctgacaatatgatgctgtgcgagaaatatttacagcacattaaaacgatctgtattattaaataaataattttcaaatgttaaacagtattaaatggcacctgattttgtgttaaattttagttccctgttgtttaatgcccccaaaatatgcagacctttgggaatataaaaatattgcacccacatgtcttaatggggctgaatttcagattatttgttacatatacttattatattgattgttgggttttgattttggtgcttgctgctgaaataaattgaaaattaatattcaataaaaatgatgtatttgtcacttgctgttaaggtagaacaagaaggaacacatattatacacataatgatgggaattacattgtgatttgtactatctacaaaggagtaactgccagttaggaagaacagtaaacagtgatgttaaaataaaacaatg

SEQ ID NO: 307839 - DNA, 1536 bp, Homo sapiens
cggccgcgagtcctgcgtgatcgcgagcatgtgtgcgtgcgcgtgtttatctgaggcgcgtgcggcggccaccccagcctagtcctcttcttggtgccactggctaactaggttgagaaaccggcgccacaggcggcacacctggcccggagctggcccgctcctccccgccgagccggcgccccaacaacgcgccctctcccagtcctcacaaaggggcctagtccggcccccggctctggccgtgagggagcgctgtgggggcgcgctgccttctgcctggaagtgttgggcaggtggtgggagagcgtcaggcttgaacaacatgattttaaagcacgtgtctgtctgtcgttttttacttttagggttttggccaaattgggcgagggcacaaaataaccacttaccccttctcaccgaggaagagcgggagaaagggtatggcacagtcacaagggtgggtgaaaagatacatcaaggccttttgtaaaggcttctttgtggcggtgcctgtggcagtgactttcttggatcgggtcgcctgtgtggcaagagtagaaggagcatcgatgcagccttctttgaatcctggggggagccagtcatctgatgtggtgcttttgaaccactggaaagtgaggaattttgaagtacaccgtggtgacattgtatcattggtgtctcctaaaaacccagaacagaagatcattaagagagtgattgctcttgaaggagatattgtcagaaccataggacacaaaaaccggtatgtcaaagtcccccgtggtcacatctgggttgaaggtgatcatcatggacacagttttgacagtaattcttttgggccggtttccctaggacttctgcatgcccatgccacacatatcctgtggcccccagagcgctggcagaaattggaatctgttcttcctccagagcgcttaccagtacagagagaagaggaatgactgcatgaatctacctgagttgctggcattgggaggccagttactggaaaggaatggaaaaaagaagcctccaaaagggaaaaacttctgacaatatgatgctgtgcgagaaatatttacagcacattaaaacgatctgtattattaaataaataattttcaaatgttaaacagtattaaatggcacctgattttgtgttaaattttagttccctgttgtttaatgcccccaaaatatgcagacctttgggaatataaaaatattgcacccacatgtcttaatggggctgaatttcagattatttgttacatatacttattatattgattgttgggttttgattttggtgcttgctgctgaaataaattgaaaattaatattcaataaaaatgatgtatttgtcacttgctgttaaggtagaacaagaaggaacacatattatacacataatgatgggaattacattgtgatttgtactatctacaaaggagtaactgccagttaggaagaacagtaaacagtgatgttaaaataaaacaatgatttgctaaagtcctgttttga

SEQ ID NO: 307840 - DNA, 1552 bp, Homo sapiens
  misc_feature (1552)..(1552): n is a, c, g, or t
cggccgcgagtcctgcgtgatcgcgagcatgtgtgcgtgcgcgtgtttatctgaggcgcgtgcggcggccaccccagcctagtcctcttcttggtgccactggctaactaggttgagaaaccggcgccacaggcggcacacctggcccggagctggcccgctcctccccgccgagccggcgccccaacaacgcgccctctcccagtcctcacaaaggggcctagtccggcccccggctctggccgtgagggagcgctgtgggggcgcgctgccttctgcctggaagtgttgggcaggtggtgggagagcgtcaggcttgaacaacatgattttaaagcacgtgtctgtctgtcgttttttacttttagggttttggccaaattgggcgagggcacaaaataaccacttaccccttctcaccgaggaagagcgggagaaagggtatggcacagtcacaagggtgggtgaaaagatacatcaaggccttttgtaaaggcttctttgtggcggtgcctgtggcagtgactttcttggatcgggtcgcctgtgtggcaagagtagaaggagcatcgatgcagccttctttgaatcctggggggagccagtcatctgatgtggtgcttttgaaccactggaaagtgaggaattttgaagtacaccgtggtgacattgtatcattggtgtctcctaaaaacccagaacagaagatcattaagagagtgattgctcttgaaggagatattgtcagaaccataggacacaaaaaccggtatgtcaaagtcccccgtggtcacatctgggttgaaggtgatcatcatggacacagttttgacagtaattcttttgggccggtttccctaggacttctgcatgcccatgccacacatatcctgtggcccccagagcgctggcagaaattggaatctgttcttcctccagagcgcttaccagtacagagagaagaggaatgactgcatgaatctacctgagttgctggcattgggaggccagttactggaaaggaatggaaaaaagaagcctccaaaagggaaaaacttctgacaatatgatgctgtgcgagaaatatttacagcacattaaaacgatctgtattattaaataaataattttcaaatgttaaacagtattaaatggcacctgattttgtgttaaattttagttccctgttgtttaatgcccccaaaatatgcagacctttgggaatataaaaatattgcacccacatgtcttaatggggctgaatttcagattatttgttacatatacttattatattgattgttgggttttgattttggtgcttgctgctgaaataaattgaaaattaatattcaataaaaatgatgtatttgtcacttgctgttaaggtagaacaagaaggaacacatattatacacataatgatgggaattacattgtgatttgtactatctacaaaggagtaactgccagttaggaagaacagtaaacagtgatgttaaaataaaacaatggcctcgttggcctcagcggtggagctctgcggccggan

SEQ ID NO: 307841 - DNA, 1271 bp, Homo sapiens
cgccggcggagggcggggtctgcgcggggacttcccccgggctgagctgcgcagcggggttttggccaaattgggcgagggcacaaaataaccacttaccccttctcaccgaggaagagcgggagaaaggtggcctgattcttttgagaagccttcctactccttactcccaaccctgatcaaaggaaaagccatgttgtatggcacagtcacaagggtgggtgaaaagatacatcaaggccttttgtaaaggcttctttgtggcggtgcctgtggcagtgactttcttggatcgggtcgcctgtgtggcaagagtagaaggagcatcgatgcagccttctttgaatcctggggggagccagtcatctgatgtggtgcttttgaaccactggaaagtgaggaattttgaagtacaccgtggtgacattgtatcattggtgtctcctaaaaacccagaacagaagatcattaagagagtgattgctcttgaaggagatattgtcagaaccataggacacaaaaaccggtatgtcaaagtcccccgtggtcacatctgggttgaaggtgatcatcatggacacagttttgacagtaattcttttgggccggtttccctaggacttctgcatgcccatgccacacatatcctgtggcccccagagcgctggcagaaattggaatctgttcttcctccagagcgcttaccagtacagagagaagaggaatgactgcatgaatctacctgagttgctggcattgggaggccagttactggaaaggaatggaaaaaagaagcctccaaaagggaaaaacttctgacaatatgatgctgtgcgagaaatatttacagcacattaaaacgatctgtattattaaataaataattttcaaatgttaaacagtattaaatggcacctgattttgtgttaaattttagttccctgttgtttaatgcccccaaaatatgcagacctttgggaatataaaaatattgcacccacatgtcttaatggggctgaatttcagattatttgttacatatacttattatattgattgttgggttttgattttggtgcttgctgctgaaataaattgaaaattaatattcaataaaaatgatgtatttgtcacttgctgttaaggtagaacaagaaggaacacatattatacacataatgatgggaattacattgtgatttgtactatctacaaaggagtaactgccagttaggaagaacagtaaacagtgatgttaaaataaaacaatg

SEQ ID NO: 307842 - DNA, 1399 bp, Homo sapiens
  misc_feature (1399)..(1399): n is a, c, g, or t
cggccgcgagtcctgcgtgatcgcgagcatgtgtgcgtgcgcgtgtttatctgaggcgcgtgcggcggccaccccagcctagtcctcttcttggtgccactggctaactaggttgagaaaccggcgccacaggcggcacacctggcccggagctggcccgctcctccccgccgagccggcgccccaacaacgcgccctctcccagtcctcacaaaggggcctagtccggcccccggctctggccgtgagggagcgctgtgggggcgcgctgccttctgcctggaagtgttgggcaggtggtgggagagcgtcaggcttgaacaacatgattttaaagcacgtgtctgtctgtcgttttttacttttagggttttggccaaattgggcgagggcacaaaataaccacttaccccttctcaccgaggaagagcgggagaaagggtatggcacagtcacaagggtgggtgaaaagatacatcaaggccttttgtaaaggcttctttgtggcggtgcctgtggcagtgactttcttggatcgggtcgcctgtgtggcaagagtagaaggagcatcgatgcagccttctttgaatcctggggggagccagtcatctgatgtggtgcttttgaaccactggaaagtgaggaattttgaagtacaccgtggtgacattgtatcattggtgtctcctaaaaacccagaacagaagatcattaagagagtgattgctcttgaaggagatattgtcagaaccataggacacaaaaaccggtatgtcaaagtcccccgtggtcacatctgggttgaaggtgatcatcatggacacagttttgacagtaattcttttgggccggtttccctaggacttctgcatgcccatgccacacatatcctgtggcccccagagcgctggcagaaattggaatctgttcttcctccagagcgcttaccagtacagagagaagaggaatgactgcatgaatctacctgagttgctggcattgggaggccagttactggaaaggaatggaaaaaagaagcctccaaaagggaaaaacttctgacaatatgatgctgtgcgagaaatatttacagcacattaaaacgatctgtattattaaataaataattttcaaatgttaaacagtattaaatggcacctgattttgtgttaaattttagttccctgttgtttaatgcccccaaaatatgcagacctttgggaatataaaaatattgcacccacatgtcttaatggggctgaatttcagattatttgttacatatacttattatattgattgttgggttttgattttggtgcttgctgctgaaataaattgaaaattaatattcaataaaagcctcgttggcctcagcggtggagctctgcggccggan

SEQ ID NO: 307843 - DNA, 1411 bp, Homo sapiens
cggccgcgagtcctgcgtgatcgcgagcatgtgtgcgtgcgcgtgtttatctgaggcgcgtgcggcggccaccccagcctagtcctcttcttggtgccactggctaactaggttgagaaaccggcgccacaggcggcacacctggcccggagctggcccgctcctccccgccgagccggcgccccaacaacgcgccctctcccagtcctcacaaaggggcctagtccggcccccggctctggccgtgagggagcgctgtgggggcgcgctgccttctgcctggaagtgttgggcaggtggtgggagagcgtcaggcttgaacaacatgattttaaagcacgtgtctgtctgtcgttttttacttttagggttttggccaaattgggcgagggcacaaaataaccacttaccccttctcaccgaggaagagcgggagaaagggtatggcacagtcacaagggtgggtgaaaagatacatcaaggccttttgtaaaggcttctttgtggcggtgcctgtggcagtgactttcttggatcgggtcgcctgtgtggcaagagtagaaggagcatcgatgcagccttctttgaatcctggggggagccagtcatctgatgtggtgcttttgaaccactggaaagtgaggaattttgaagtacaccgtggtgacattgtatcattggtgtctcctaaaaacccagaacagaagatcattaagagagtgattgctcttgaaggagatattgtcaggtttccctaggacttctgcatgcccatgccacacatatcctgtggcccccagagcgctggcagaaattggaatctgttcttcctccagagcgcttaccagtacagagagaagaggaatgactgcatgaatctacctgagttgctggcattgggaggccagttactggaaaggaatggaaaaaagaagcctccaaaagggaaaaacttctgacaatatgatgctgtgcgagaaatatttacagcacattaaaacgatctgtattattaaataaataattttcaaatgttaaacagtattaaatggcacctgattttgtgttaaattttagttccctgttgtttaatgcccccaaaatatgcagacctttgggaatataaaaatattgcacccacatgtcttaatggggctgaatttcagattatttgttacatatacttattatattgattgttgggttttgattttggtgcttgctgctgaaataaattgaaaattaatattcaataaaaatgatgtatttgtcacttgctgttaaggtagaacaagaaggaacacatattatacacataatgatgggaattacattgtgatttgtactatctacaaaggagtaactgccagttaggaagaacagtaaacagtgatgttaaaataaaacaatg

SEQ ID NO: 307844 - DNA, 1070 bp, Homo sapiens
agatttacctcctcatctggctcttcatttgtggtacttttaatgcaccagtaatggtaggagaggacattgaagcaaggagacactttctgaacctctgttgccaaccgagaagagttagcctaagattgaagaagtgcatatctgaggtcaaggacaaggcgggcagtgctcaatgtcatcctttagaacagagggcaggaatcccatctggagagtggaggcaactgaaagagaggtctcctaaaaacccagaacagaagatcattaagagagtgattgctcttgaaggagatattgtcagaaccataggacacaaaaaccggtatgtcaaagtcccccgtggtcacatctgggttgaaggtgatcatcatggacacagttttgacagtaattcttttgggccggtttccctaggacttctgcatgcccatgccacacatatcctgtggcccccagagcgctggcagaaattggaatctgttcttcctccagagcgcttaccagtacagagagaagaggaatgactgcatgaatctacctgagttgctggcattgggaggccagttactggaaaggaatggaaaaaagaagcctccaaaagggaaaaacttctgacaatatgatgctgtgcgagaaatatttacagcacattaaaacgatctgtattattaaataaataattttcaaatgttaaacagtattaaatggcacctgattttgtgttaaattttagttccctgttgtttaatgcccccaaaatatgcagacctttgggaatataaaaatattgcacccacatgtcttaatggggctgaatttcagattatttgttacatatacttattatattgattgttgggttttgattttggtgcttgctgctgaaataaattgaaaattaatattcaataaaaatgatgtatttgtcacttgctgttaaggtagaacaagaaggaacacatattatacacataatgatgggaattacattgtgatttgtactatctacaaaggagtaactgccagttaggaagaacagtaaacagtgatgttaaaataaaacaatg

SEQ ID NO: 307845 - DNA, 958 bp, Homo sapiens
gtttctagcagtggttttaaatcatggttcaacctgcccttaactcctctctgctctcgtttgtgtagtttctcctgaactgctcttggtctccatgaaggctactggcaggagcacatgagagaggtctcctaaaaacccagaacagaagatcattaagagagtgattgctcttgaaggagatattgtcagaaccataggacacaaaaaccggtatgtcaaagtcccccgtggtcacatctgggttgaaggtgatcatcatggacacagttttgacagtaattcttttgggccggtttccctaggacttctgcatgcccatgccacacatatcctgtggcccccagagcgctggcagaaattggaatctgttcttcctccagagcgcttaccagtacagagagaagaggaatgactgcatgaatctacctgagttgctggcattgggaggccagttactggaaaggaatggaaaaaagaagcctccaaaagggaaaaacttctgacaatatgatgctgtgcgagaaatatttacagcacattaaaacgatctgtattattaaataaataattttcaaatgttaaacagtattaaatggcacctgattttgtgttaaattttagttccctgttgtttaatgcccccaaaatatgcagacctttgggaatataaaaatattgcacccacatgtcttaatggggctgaatttcagattatttgttacatatacttattatattgattgttgggttttgattttggtgcttgctgctgaaataaattgaaaattaatattcaataaaaatgatgtatttgtcacttgctgttaaggtagaacaagaaggaacacatattatacacataatgatgggaattacattgtgatttgtactatctacaaaggagtaactgccagttaggaagaacagtaaacagtgatgttaaaataaaacaatg

SEQ ID NO: 307846 - DNA, 1449 bp, Homo sapiens
  misc_feature (1449)..(1449): n is a, c, g, or t
cggccgcgagtcctgcgtgatcgcgagcatgtgtgcgtgcgcgtgtttatctgaggcgcgtgcggcggccaccccagcctagtcctcttcttggtgccactggctaactaggttgagaaaccggcgccacaggcggcacacctggcccggagctggcccgctcctccccgccgagccggcgccccaacaacgcgccctctcccagtcctcacaaaggggcctagtccggcccccggctctggccgtgagggagcgctgtgggggcgcgctgccttctgcctggaagtgttgggcaggtggtgggagagcgtcaggcttgaacaacatgattttaaagcacgtgtctgtctgtcgttttttacttttagggttttggccaaattgggcgagggcacaaaataaccacttaccccttctcaccgaggaagagcgggagaaagggtatggcacagtcacaagggtgggtgaaaagatacatcaaggccttttgtaaaggcttctttgtggcggtgcctgtggcagtgactttcttggatcgggtcgcctgtgtggcaagagtagaaggagcatcgatgcagccttctttgaatcctggggggagccagtcatctgatgtggtgcttttgaaccactggaaagtgaggaattttgaagtacaccgtggtgacattgtatcattggtgtctcctaaaaacccagaacagaagatcattaagagagtgattgctcttgaaggagatattgtcaggtttccctaggacttctgcatgcccatgccacacatatcctgtggcccccagagcgctggcagaaattggaatctgttcttcctccagagcgcttaccagtacagagagaagaggaatgactgcatgaatctacctgagttgctggcattgggaggccagttactggaaaggaatggaaaaaagaagcctccaaaagggaaaaacttctgacaatatgatgctgtgcgagaaatatttacagcacattaaaacgatctgtattattaaataaataattttcaaatgttaaacagtattaaatggcacctgattttgtgttaaattttagttccctgttgtttaatgcccccaaaatatgcagacctttgggaatataaaaatattgcacccacatgtcttaatggggctgaatttcagattatttgttacatatacttattatattgattgttgggttttgattttggtgcttgctgctgaaataaattgaaaattaatattcaataaaaatgatgtatttgtcacttgctgttaaggtagaacaagaaggaacacatattatacacataatgatgggaattacattgtgatttgtactatctacaaaggagtaactgccagttaggaagaacagtaaacagtgatgttaaaataaaacaatggcctcgttggcctcagcggtggagctctgcggccggan

SEQ ID NO: 307847 - DNA, 912 bp, Homo sapiens
acttcaaatggtttttgtgaggattaaaggagtttatatacaatagcacctagaaaaatgctatataagtgcttactgtatttttctttgtatttcaatggctacaaaaggtgtttactattttttttattcatcatcacttctccctgggatgttaaacctggattaaattctgctttcaagctattaataatgattcttataaaatgatctctttattgctttctttctgtttctcatggaattaaggtttccctaggacttctgcatgcccatgccacacatatcctgtggcccccagagcgctggcagaaattggaatctgttcttcctccagagcgcttaccagtacagagagaagaggaatgactgcatgaatctacctgagttgctggcattgggaggccagttactggaaaggaatggaaaaaagaagcctccaaaagggaaaaacttctgacaatatgatgctgtgcgagaaatatttacagcacattaaaacgatctgtattattaaataaataattttcaaatgttaaacagtattaaatggcacctgattttgtgttaaattttagttccctgttgtttaatgcccccaaaatatgcagacctttgggaatataaaaatattgcacccacatgtcttaatggggctgaatttcagattatttgttacatatacttattatattgattgttgggttttgattttggtgcttgctgctgaaataaattgaaaattaatattcaataaaaatgatgtatttgtcacttgctgttaaggtagaacaagaaggaacacatattatacacataatgatgggaattacattgtgatttgtactatctacaaaggagtaactgccagttaggaagaacagtaaacagtgatgttaaaataaaacaatg

SEQ ID NO: 307848 - DNA, 1040 bp, Homo sapiens
cggccgcgagtcctgcgtgatcgcgagcatgtgtgcgtgcgcgtgtttatctgaggcgcgtgcggcggccaccccagcctagtcctcttcttggtgccactggctaactaggttgagaaaccggcgccacaggcggcacacctggcccggagctggcccgctcctccccgccgagccggcgccccaacaacgcgccctctcccagtcctcacaaaggggcctagtccggcccccggctctggccgtgagggagcgctgtgggggcgcgctgccttctgcctggaagtgttgggcaggtggtgggagagcgtcaggcttgaacaacatgattttaaagcacgtgtctgtctgtcgttttttacttttagggttttggccaaattgggcgagggcacaaaataaccacttaccccttctcaccgaggaagagcgggagaaagggtatggcacagtcacaagggtgggtgaaaagatacatcaaggccttttgtaaaggcttctttgtggcggtgcctgtggcagtgactttcttggatcgggtcgcctgtgtggcaagagtagaaggagcatcgatgcagccttctttgaatcctggggggagccagtcatctgatgtggtgcttttgaaccactggaaagtgaggaattttgaagtacaccgtggtgacattgtatcattggtcagcagcacagcaagtggataaaagcacagactctggagccagcctgtctagattcaaattttatttactctatctgtgatcttggcctcattaagttatctctgttttagtttttttcctatggttaatgatagtcccaacctcatagaatagctttgaacattcagtgagttattccacatgaagcacttagaggaactattagtattcaagtgtttcataacaaagtataatcatttgacaataaataaactaatatactcatttggtaacacacacagacccacacacacacacacacatacacgtatgtcatccactgtttgcaattgtgagattatactcccagaagtaatt

SEQ ID NO: 307849 - DNA, 977 bp, Homo sapiens
cggccgcgagtcctgcgtgatcgcgagcatgtgtgcgtgcgcgtgtttatctgaggcgcgtgcggcggccaccccagcctagtcctcttcttggtgccactggctaactaggttgagaaaccggcgccacaggcggcacacctggcccggagctggcccgctcctccccgccgagccggcgccccaacaacgcgccctctcccagtcctcacaaaggggcctagtccggcccccggctctggccgtgagggagcgctgtgggggcgcgctgccttctgcctggaagtgttgggcaggtggtgggagagcgtcaggcttgaacaacatgattttaaagcacgtgtctgtctgtcgttttttacttttagggttttggccaaattgggcgagggcacaaaataaccacttaccccttctcaccgaggaagagcgggagaaagggtatggcacagtcacaagggtgggtgaaaagatacatcaaggccttttgtaaaggcttctttgtggcggtgcctgtggcagtgactttcttggatcgggtcgcctgtgtggcaagagtagaaggagcatcgatgcagccttctttgaatcctggggggagccagtcatctgatgtggtgcttttgaaccactggaaagtgaggaattttgaagtacaccgtggtgacattgtatcattggtaaacacatatatagcaaagcagactgtcctttctattgcaaggggttttgttcagagttggttgaccagtgttgtttcctaaagcatgggagatctggcagagggaggtgggtgcatattatttttttgcatatctttcttatttttcactgtctctttctttctgtaaaaagttggtcacagtggagttattgtttaagtatgttattcagtagctacatttatttaataacattattggttgcacaaaatatgatttgctgtcatcaagtcctcactatagtatatgtaggtg

SEQ ID NO: 307850 - DNA, 379 bp, Homo sapiens
attacttgggaaatacatctgaagtccatgagggccaaagttttggagacattccaaatgagctggtacatctttagtgagcatcattaacctttcaggttgtaaggaatatagataaacttactgatcatattgttattctttaattgtgaagtataggataaatattaatttaaattaaccatatagtctaaaatgatcattaaatcattattgatcagatattaaaagtagcatgactattttaagattaagattatgatgttaaggttcatttaaaaaaattcaagaacatttaactattttagaagcaaatgcagaaactaagaggactcttttgtactcatagagatgggagaaaactgaaaaggatatgaaa

SEQ ID NO: 307851 - DNA, 6740 bp, Homo sapiens
cggtcccgccccttcctaccttccagtagccggcggcggtgtctcaggcggcaatggaaggatccgagcctgtggccgcccatcagggggaagaggcgtcctgttcttcctgggggactggcagcacaaataaaaatttgcccattatgtcaacagcatctgtggaaatcgatgatgcattgtatagtcgacagaggtacgttcttggagacacagcaatgcagaagatggccaagtcccatgttttcttaagtgggatgggtggtcttggtttggaaattgcaaagaatcttgttcttgcagggattaaggcagttacaattcatgatacagaaaaatgccaagcatgggatctaggaaccaacttctttctcagtgaagatgatgttgttaataagagaaacagggctgaagctgtacttaaacatattgcagaactaaatccatacgttcatgtcacatcatcttctgttcctttcaatgagaccacagatctctcctttttagataaataccagtgtgtagtattgactgagatgaaacttccattgcagaagaagatcaatgacttttgccgttctcagtgccctccaattaagtttatcagtgcagatgtacatggaatttggtcaaggttattttgtgatttcggtgatgaatttgaagttttagatacaacaggagaagaaccaaaagaaattttcatttcaaacataacgcaagcaaatcctggcattgttacttgccttgaaaatcatcctcacaaactggagacaggacaattcctaacatttcgagaaattaatggaatgacaggtttaaatggatctatacaacaaataacggtgatatcgccattttcttttagtattggtgacaccacagaactggaaccatatttacatggaggcatagctgtccaagttaagactcctaaaacagttttttttgaatcactggagaggcagttaaaacatccaaagtgccttattgtggattttagcaaccctgaggcacctttagagattcacacagctatgcttgccttggaccagtttcaggagaaatacagtcgcaagccaaatgttggatgccaacaagattcagaagaactgttgaaactagcaacatctataagtgaaaccttggaagagaagcctgatgtaaatgctgacattgtgcattggctctcttggactgcccaaggctttttatctccacttgctgcagcagtaggaggtgttgccagccaagaagtattgaaagctgtaacaggaaaattttctcctttgtgccagtggttatatcttgaagcagcagatattgttgaatcactaggcaaacctgaatgtgaagaatttctcccacgaggagatagatatgatgccttaagagcttgcattggagacactttgtgtcagaaactgcaaaatttaaacatcttcttagtagggtgtggagccataggctgtgaaatgttgaaaaattttgctttacttggtgttggcacaagcaaagagaaaggaatgattacagttacagatcctgacttgatagagaaatccaacttaaatagacagttcctatttcgtcctcatcacatacagaaacctaaaagctacactgctgctgatgctactctgaaaataaattctcaaataaagatagatgcacacctgaacaaagtatgtccaaccactgagaccatttacaatgatgagttctatactaaacaagatgtaattattacagcattagataatgtggaagccaggagatacgtagacagtcgttgcttagcaaatctaaggcctcttttagattctggaacaatgggcactaagggacacactgaagttattgtaccgcatttgactgagtcttacaatagtcatcgggatcccccagaagaggaaataccattttgtactctaaaatcctttccagctgctattgaacacaccatacagtgggcaagagataagtttgaaagttccttttcccacaaaccttcattgtttaacaaattttggcaaacctattcatctgcagaagaagtcttacagaagatacagagtggacacagtttagaaggctgttttcaagttataaagttacttagcagaagacctagaaattggtcccagtgtgtagaattagcaagattaaagtttgaaaaatattttaaccataaggctcttcagcttcttcactgtttccctctggacatacgattaaaagatggcagtttattttggcagtcaccaaagaggccaccctctccaataaaatttgatttaaatgagcctttgcacctcagtttccttcagaatgctgcaaaactatatgctacagtatattgtattccatttgcagaagaggacttatcagcagatgccctcttgaatattctttcagaagtaaagattcaggaattcaagccttccaataaggttgttcaaacagatgaaactgcaaggaaaccagaccatgttcctattagcagtgaagatgagaggaatgcaattttccaactagaaaaggctattttatctaatgaagccaccaaaagtgaccttcagatggcagtgctttcatttgaaaaagatgatgatcataatggacacatagatttcatcacagctgcatcaaatcttcgtgccaaaatgtacagcattgaaccagctgaccgtttcaaaacaaagcgcatagctggtaaaattatacctgctatagcaacaaccactgctacagtttctggcttggttgccttggagatgatcaaagtaactggtggctatccatttgaagcttacaaaaattgttttcttaacttagccattccaattgtagtatttacagagacaactgaagtaaggaaaactaaaatcagaaatggaatatcatttacaatttgggatcgatggaccgtacatggaaaagaagatttcaccctcttggatttcataaatgcagtcaaagagaagtatggaattgagccaacaatggtggtacagggagtcaaaatgctttatgttcctgtaatgcctggtcatgcaaaaagattgaagttaacaatgcataaacttgtaaaacctactactgaaaagaaatatgtggatcttactgtgtcatttgctccagacattgatggagatgaagatttgccgggacctccagtaagatactacttcagtcatgacactgattaatacaagttgtcttaacgttactccaggaccacttgattttggaaagagtgcacttaattcagaagctaaagaaaatcagttcataatactatggatttctctttcattaagccttaattttaagggaaacatcagtaagaaactgcactgaagaattataaaacattttggggcatagcatacacttgtctaacggttcacacgtggctatgatcacaagcaactttgaactggaatgctatttacaaaagttttgtgtattaatctgtgtattaatctctctggataaaaagaaggaaaaaatatgtatgaccagaacagatatggatgaagaaattgaaagcaacgaatgcaactattcaaaaagtttaattttatgaatttcttttttgtttagtcttgaagactgattttctatgcaaatagtgtttggcatcctgcacctctgatatgatttggctttgagaatttaataccactgggaagaagtatggtagtggtggatgaagggtggatattttaaattgtgcagttacagtttactgtcctattacctctgctcgtttaaccagtttgttatatcactgtgtccccaaaatcaggatttttgttgatagcatcagtgttgtaggagcaataggtcagatgagacatattaacttagactaaacgtgaacagtattatatggactctcacaacgctcttagagaatccgtgaatgtgaacagacaaatgtggctaaccatttgattcttcagtatgccttctaatgtggctattttatttatgtgagactctaaacctgattgtcctaatatataaaactaaaagattttgtaaagggagtgtctttagaaatagatgaaatgtagaatgttaaaaattattgctagggtagtcttttttttccagaaacctaattagggtattaaattttgtgttttttttttttttttttttttaaacagaagcatgttatttcattcccattcccagaaagggagttaatgaagataaaaatttattttttaaggtctttattgagagaaactttgttttctgatatgaactattgcagatgtttttataaatactttcattaaaatgatgtaaacagtagtacccaacactgtaaactcagtgaaaatagtaaatgattcttttattactaagactgtcatgcattctgaagcagttggcttttttttaaccataggaagtcatttccctctagctcctttccttctactctcctgctcagaccattagtaggtactttgttaaataaaaaactagattaacatcaatattactccaatttggtatcttttacactatgtattatacctactttctttttatttcatttacaaatagtttaaattactttatcaaccagctgtattgtttccctcttgtaaaagtaccatcaagtggggaaaatgtatgtggaagtggagagtgaatttgtatgactaaaggataatctgtacatggggaagtgggcaaaagtggataggatgaatttaaagaaaatgactacctttggaaaaaagaaattaaattttgttcacatatcctaccctttcccattgtgcatatcccaagtgtcatatttaaaactaaggttacttaaaacagaatccaggaatatcaaggctctgtggcttggaattttagaggataggactaataaaaggacttttgcaaagaaggcttttttccacgttcactttgttttgtgttctttgaaagtaactgatacttttcgggtagttaattcagcagtccataaatatgatccagtaacttgcttatattttattgaagtctcgacagctcttcagaagtaaatttagaacgatgctgtcagttcatatttatagatattagtgttttagcagataaaacaaaatcaacaaaaattaagttcattttgtgattaaacctgcaaccatttttccattactttttttctatagttaatggttattgccatgatttcttctgtttggttctactaagctagaaagccagggtgaagttaatgataattcccattattttatttctgtaccatgagattgctgttgatgactgaaataccaggtgcaaaaattaatgatttgatttttgtacagtttcaatgagtattttttacttattaaaaataaattaagaaatgtaagaatatctttgtaaatcatgtttcataagttgactccagagattctgattttgctgtttattttgtgagtaatgttgctttggtgtttcctgattttcaagtttgcaatcatggagatacagcagttattaggtgtggaaggacattacctcaaatgtcctcagatggctccaggaaattcttttaaaacagttggagagaaatagtcgtgaccatgtaaaacctagaggatctggtaaatcccatactactggttagggatttgtaaagtccatttctttttagagttcaaagcagttctgttacttgtccataagttcctcataaattgtcccaaaggtaggacatggaaataaatgtatatctttattttttaatctactatgtcacactctggtgatattcatggaacattaaaaaagcaactatgtttattttataattagtaaaatgaagatagaaaattgttcttttgaaatttttagggaaaaaaaaaatctcgtgacctaaatctttccactataatgaatattcattgtgattgcaaatatctaattttatataatcactgtgtatggatttagcgattttacttttcatagattcaaaaacatataatctgaatgctttctctgaaaaaaaaaaaaatcagagttgagctcttgaggatcagagttaagtatccattgataatatgtgttcattttgctctatgtcataactttgtttttttattgagaaatatatatttttcaaaaacacatatatattcaaaaatacataaaatataaatatgcagttcaaggaataattttaaagcaactatataactagcactcagcttagtagaatatattgacagcagttcagaaattacacatgtagttccttcccagtcacaaccagctccctgccacgtaccctttggtaattaccactatcctaccttgtatgataatgtctctttgtttttatagtgttaccacctatgtgtgtaaacttaaacaatacagtttgcttgtttttgagttttatttaaaatcatacattcttttgtagctgcatttgttcaagatgggattgattcatgttggttgtagctgtactttattcttcattatgtctgtgtaatttacttttctgttaatatgccacaatttatttactgtagacaattgggatgtttttagtttcaggcaattacagtttcacaatgaacatcattttatgtaactcctagtacaaagagtatatatttaggagtagaattttttggtcatagggtattcatatcttaaattttattagatgattacaaatttttttctaagcattagta

SEQ ID NO: 307852 - DNA, 4926 bp, Homo sapiens
cggtcccgccccttcctaccttccagtagccggcggcggtgtctcaggcggcaatggaaggatccgagcctgtggccgcccatcagggggaagaggcgtcctgttcttcctgggggactggcagcacaaataaaaatttgcccattatgtcaacagcatctgtggaaatcgatgatgcattgtatagtcgacagaggtacgttcttggagacacagcaatgcagaagatggccaagtcccatgttttcttaagtgggatgggtggtcttggtttggaaattgcaaagaatcttgttcttgcagggattaaggcagttacaattcatgatacagaaaaatgccaagcatgggatctaggaaccaacttctttctcagtgaagatgatgttgttaataagagaaacagggctgaagctgtacttaaacatattgcagaactaaatccatacgttcatgtcacatcatcttctgttcctttcaatgagaccacagatctctcctttttagataaataccagtgtgtagtattgactgagatgaaacttccattgcagaagaagatcaatgacttttgccgttctcagtgccctccaattaagtttatcagtgcagatgtacatggaatttggtcaaggttattttgtgatttcggtgatgaatttgaagttttagatacaacaggagaagaaccaaaagaaattttcatttcaaacataacgcaagcaaatcctggcattgttacttgccttgaaaatcatcctcacaaactggagacaggacaattcctaacatttcgagaaattaatggaatgacaggtttaaatggatctatacaacaaataacggtgatatcgccattttcttttagtattggtgacaccacagaactggaaccatatttacatggaggcatagctgtccaagttaagactcctaaaacagttttttttgaatcactggagaggcagttaaaacatccaaagtgccttattgtggattttagcaaccctgaggcacctttagagattcacacagctatgcttgccttggaccagtttcaggagaaatacagtcgcaagccaaatgttggatgccaacaagattcagaagaactgttgaaactagcaacatctataagtgaaaccttggaagagaagcctgatgtaaatgctgacattgtgcattggctctcttggactgcccaaggctttttatctccacttgctgcagcagtaggaggtgttgccagccaagaagtattgaaagctgtaacaggaaaattttctcctttgtgccagtggttatatcttgaagcagcagatattgttgaatcactaggcaaacctgaatgtgaagaatttctcccacgaggagatagatatgatgccttaagagcttgcattggagacactttgtgtcagaaactgcaaaatttaaacatcttcttagtagggtgtggagccataggctgtgaaatgttgaaaaattttgctttacttggtgttggcacaagcaaagagaaaggaatgattacagttacagatcctgacttgatagagaaatccaacttaaatagacagttcctatttcgtcctcatcacatacagaaacctaaaagctacactgctgctgatgctactctgaaaataaattctcaaataaagatagatgcacacctgaacaaagtatgtccaaccactgagaccatttacaatgatgagttctatactaaacaagatgtaattattacagcattagataatgtggaagccaggagatacgtagacagtcgttgcttagcaaatctaaggcctcttttagattctggaacaatgggcactaagggacacactgaagttattgtaccgcatttgactgagtcttacaatagtcatcgggatcccccagaagaggaaataccattttgtactctaaaatcctttccagctgctattgaacacaccatacagtgggcaagagataagtttgaaagttccttttcccacaaaccttcattgtttaacaaattttggcaaacctattcatctgcagaagaagtcttacagaagatacagagtggacacagtttagaaggctgttttcaagttataaagttacttagcagaagacctagaaattggtcccagtgtgtagaattagcaagattaaagtttgaaaaatattttaaccataaggctcttcagcttcttcactgtttccctctggacatacgattaaaagatggcagtttattttggcagtcaccaaagaggccaccctctccaataaaatttgatttaaatgagcctttgcacctcagtttccttcagaatgctgcaaaactatatgctacagtatattgtattccatttgcagaagaggacttatcagcagatgccctcttgaatattctttcagaagtaaagattcaggaattcaagccttccaataaggttgttcaaacagatgaaactgcaaggaaaccagaccatgttcctattagcagtgaagatgagaggaatgcaattttccaactagaaaaggctattttatctaatgaagccaccaaaagtgaccttcagatggcagtgctttcatttgaaaaagatgatgatcataatggacacatagatttcatcacagctgcatcaaatcttcgtgccaaaatgtacagcattgaaccagctgaccgtttcaaaacaaagcgcatagctggtaaaattatacctgctatagcaacaaccactgctacagtttctggcttggttgccttggagatgatcaaagtaactggtggctatccatttgaagcttacaaaaattgttttcttaacttagccattccaattgtagtatttacagagacaactgaagtaaggaaaactaaaatcagaaatggaatatcatttacaatttgggatcgatggaccgtacatggaaaagaagatttcaccctcttggatttcataaatgcagtcaaagagaagtatggaattgagccaacaatggtggtacagggagtcaaaatgctttatgttcctgtaatgcctggtcatgcaaaaagattgaagttaacaatgcataaacttgtaaaacctactactgaaaagaaatatgtggatcttactgtgtcatttgctccagacattgatggagatgaagatttgccgggacctccagtaagatactacttcagtcatgacactgattaatacaagttgtcttaacgttactccaggaccacttgattttggaaagagtgcacttaattcagaagctaaagaaaatcagttcataatactatggatttctctttcattaagccttaattttaagggaaacatcagtaagaaactgcactgaagaattataaaacattttggggcatagcatacacttgtctaacggttcacacgtggctatgatcacaagcaactttgaactggaatgctatttacaaaagttttgtgtattaatctgtgtattaatctctctggataaaaagaaggaaaaaatatgtatgaccagaacagatatggatgaagaaattgaaagcaacgaatgcaactattcaaaaagtttaattttatgaatttcttttttgtttagtcttgaagactgattttctatgcaaatagtgtttggcatcctgcacctctgatatgatttggctttgagaatttaataccactgggaagaagtatggtagtggtggatgaagggtggatattttaaattgtgcagttacagtttactgtcctattacctctgctcgtttaaccagtttgttatatcactgtgtccccaaaatcaggatttttgttgatagcatcagtgttgtaggagcaataggtcagatgagacatattaacttagactaaacgtgaacagtattatatggactctcacaacgctcttagagaatccgtgaatgtgaacagacaaatgtggctaaccatttgattcttcagtatgccttctaatgtggctattttatttatgtgagactctaaacctgattgtcctaatatataaaactaaaagattttgtaaagggagtgtctttagaaatagatgaaatgtagaatgttaaaaattattgctagggtagtcttttttttccagaaacctaattagggtattaaattttgtgttttttttttttttttttttttaaacagaagcatgttatttcattcccattcccagaaagggagttaatgaagataaaaatttattttttaaggtctttattgagagaaactttgttttctgatatgaactattgcagatgtttttataaatactttcattaaaatgatgtaaacagtagtacccaacactgtaaactcagtgaaaatagtaaatgattcttttattactaagactgtcatgcattctgaagcagttggcttttttttaaccataggaagtcatttccctctagctcctttccttctactctcctgctcagaccattagtaggtactttgttaaataaaaaactagattaacatcaatattactccaatttggtatcttttacactatgtattatacctactttctttttatttcatttacaaatagtttaaattactttatcaaccagctgtattgtttccctcttgtaaaagtaccatcaagtggggaaaatgtatgtggaagtggagagtgaatttgtatgactaaaggataatctgtacatggggaagtgggcaaaagtggataggatgaatttaaagaaaatgactacctttggaaaaaagaaattaaattttgttcacatatcctaccctttcccattgtgcatatcccaagtgtcatatttaaaactaaggttacttaaaacagaatccaggaatatcaaggctctgtggcttggaattttagaggataggactaataaaaggacttttgcaaaga

SEQ ID NO: 307853 - DNA, 5400 bp, Homo sapiens
cggtcccgccccttcctaccttccagtagccggcggcggtgtctcaggcggcaatggaaggatccgagcctgtggccgcccatcagggggaagaggcgtcctgttcttcctgggggactggcagcacaaataaaaatttgcccattatgtcaacagcatctgtggaaatcgatgatgcattgtatagtcgacagaggtacgttcttggagacacagcaatgcagaagatggccaagtcccatgttttcttaagtgggatgggtggtcttggtttggaaattgcaaagaatcttgttcttgcagggattaaggcagttacaattcatgatacagaaaaatgccaagcatgggatctaggaaccaacttctttctcagtgaagatgatgttgttaataagagaaacagggctgaagctgtacttaaacatattgcagaactaaatccatacgttcatgtcacatcatcttctgttcctttcaatgagaccacagatctctcctttttagataaataccagtgtgtagtattgactgagatgaaacttccattgcagaagaagatcaatgacttttgccgttctcagtgccctccaattaagtttatcagtgcagatgtacatggaatttggtcaaggttattttgtgatttcggtgatgaatttgaagttttagatacaacaggagaagaaccaaaagaaattttcatttcaaacataacgcaagcaaatcctggcattgttacttgccttgaaaatcatcctcacaaactggagacaggacaattcctaacatttcgagaaattaatggaatgacaggtttaaatggatctatacaacaaataacggtgatatcgccattttcttttagtattggtgacaccacagaactggaaccatatttacatggaggcatagctgtccaagttaagactcctaaaacagttttttttgaatcactggagaggcagttaaaacatccaaagtgccttattgtggattttagcaaccctgaggcacctttagagattcacacagctatgcttgccttggaccagtttcaggagaaatacagtcgcaagccaaatgttggatgccaacaagattcagaagaactgttgaaactagcaacatctataagtgaaaccttggaagagaagcctgatgtaaatgctgacattgtgcattggctctcttggactgcccaaggctttttatctccacttgctgcagcagtaggaggtgttgccagccaagaagtattgaaagctgtaacaggaaaattttctcctttgtgccagtggttatatcttgaagcagcagatattgttgaatcactaggcaaacctgaatgtgaagaatttctcccacgaggagatagatatgatgccttaagagcttgcattggagacactttgtgtcagaaactgcaaaatttaaacatcttcttagtagggtgtggagccataggctgtgaaatgttgaaaaattttgctttacttggtgttggcacaagcaaagagaaaggaatgattacagttacagatcctgacttgatagagaaatccaacttaaatagacagttcctatttcgtcctcatcacatacagaaacctaaaagctacactgctgctgatgctactctgaaaataaattctcaaataaagatagatgcacacctgaacaaagtatgtccaaccactgagaccatttacaatgatgagttctatactaaacaagatgtaattattacagcattagataatgtggaagccaggagatacgtagacagtcgttgcttagcaaatctaaggcctcttttagattctggaacaatgggcactaagggacacactgaagttattgtaccgcatttgactgagtcttacaatagtcatcgggatcccccagaagaggaaataccattttgtactctaaaatcctttccagctgctattgaacacaccatacagtgggcaagagataagtttgaaagttccttttcccacaaaccttcattgtttaacaaattttggcaaacctattcatctgcagaagaagtcttacagaagatacagagtggacacagtttagaaggctgttttcaagttataaagttacttagcagaagacctagaaattggtcccagtgtgtagaattagcaagattaaagtttgaaaaatattttaaccataaggctcttcagcttcttcactgtttccctctggacatacgattaaaagatggcagtttattttggcagtcaccaaagaggccaccctctccaataaaatttgatttaaatgagcctttgcacctcagtttccttcagaatgctgcaaaactatatgctacagtatattgtattccatttgcagaagaggacttatcagcagatgccctcttgaatattctttcagaagtaaagattcaggaattcaagccttccaataaggttgttcaaacagatgaaactgcaaggaaaccagaccatgttcctattagcagtgaagatgagaggaatgcaattttccaactagaaaaggctattttatctaatgaagccaccaaaagtgaccttcagatggcagtgctttcatttgaaaaagatgatgatcataatggacacatagatttcatcacagctgcatcaaatcttcgtgccaaaatgtacagcattgaaccagctgaccgtttcaaaacaaagcgcatagctggtaaaattatacctgctatagcaacaaccactgctacagtttctggcttggttgccttggagatgatcaaagtaactggtggctatccatttgaagcttacaaaaattgttttcttaacttagccattccaattgtagtatttacagagacaactgaagtaaggaaaactaaaatcagaaatggaatatcatttacaatttgggatcgatggaccgtacatggaaaagaagatttcaccctcttggatttcataaatgcagtcaaagagaagtatggaattgagccaacaatggtggtacagggagtcaaaatgctttatgttcctgtaatgcctggtcatgcaaaaagattgaagttaacaatgcataaacttgtaaaacctactactgaaaagaaatatgtggatcttactgtgtcatttgctccagacattgatggagatgaagatttgccgggacctccagtaagatactacttcagtcatgacactgattaatacaagttgtcttaacgttactccaggaccacttgattttggaaagagtgcacttaattcagaagctaaagaaaatcagttcataatactatggatttctctttcattaagccttaattttaagggaaacatcagtaagaaactgcactgaagaattataaaacattttggggcatagcatacacttgtctaacggttcacacgtggctatgatcacaagcaactttgaactggaatgctatttacaaaagttttgtgtattaatctgtgtattaatctctctggataaaaagaaggaaaaaatatgtatgaccagaacagatatggatgaagaaattgaaagcaacgaatgcaactattcaaaaagtttaattttatgaatttcttttttgtttagtcttgaagactgattttctatgcaaatagtgtttggcatcctgcacctctgatatgatttggctttgagaatttaataccactgggaagaagtatggtagtggtggatgaagggtggatattttaaattgtgcagttacagtttactgtcctattacctctgctcgtttaaccagtttgttatatcactgtgtccccaaaatcaggatttttgttgatagcatcagtgttgtaggagcaataggtcagatgagacatattaacttagactaaacgtgaacagtattatatggactctcacaacgctcttagagaatccgtgaatgtgaacagacaaatgtggctaaccatttgattcttcagtatgccttctaatgtggctattttatttatgtgagactctaaacctgattgtcctaatatataaaactaaaagattttgtaaagggagtgtctttagaaatagatgaaatgtagaatgttaaaaattattgctagggtagtcttttttttccagaaacctaattagggtattaaattttgtgttttttttttttttttttttttaaacagaagcatgttatttcattcccattcccagaaagggagttaatgaagataaaaatttattttttaaggtctttattgagagaaactttgttttctgatatgaactattgcagatgtttttataaatactttcattaaaatgatgtaaacagtagtacccaacactgtaaactcagtgaaaatagtaaatgattcttttattactaagactgtcatgcattctgaagcagttggcttttttttaaccataggaagtcatttccctctagctcctttccttctactctcctgctcagaccattagtaggtactttgttaaataaaaaactagattaacatcaatattactccaatttggtatcttttacactatgtattatacctactttctttttatttcatttacaaatagtttaaattactttatcaaccagctgtattgtttccctcttgtaaaagtaccatcaagtggggaaaatgtatgtggaagtggagagtgaatttgtatgactaaaggataatctgtacatggggaagtgggcaaaagtggataggatgaatttaaagaaaatgactacctttggaaaaaagaaattaaattttgttcacatatcctaccctttcccattgtgcatatcccaagtgtcatatttaaaactaaggttacttaaaacagaatccaggaatatcaaggctctgtggcttggaattttagaggataggactaataaaaggacttttgcaaagaaggcttttttccacgttcactttgttttgtgttctttgaaagtaactgatacttttcgggtagttaattcagcagtccataaatatgatccagtaacttgcttatattttattgaagtctcgacagctcttcagaagtaaatttagaacgatgctgtcagttcatatttatagatattagtgttttagcagataaaacaaaatcaacaaaaattaagttcattttgtgattaaacctgcaaccatttttccattactttttttctatagttaatggttattgccatgatttcttctgtttggttctactaagctagaaagccagggtgaagttaatgataattcccattattttatttctgtaccatgagattgctgttgatgactgaaataccaggtgcaaaaattaatgatttgatttttgtacagtttcaatgagtattttttacttattaaaaataaattaagaaatgta

SEQ ID NO: 307854 - DNA, 6760 bp, Homo sapiens
cggtcccgccccttcctaccttccagtagccggcggcggtgtctcaggcggcaatggaaggatccgagcctgtggccgcccatcagggggaagaggcgtcctgttcttcctgggggactggcagcacaaataaaaatttgcccattatgtcaacagcatctgtggaaatcgatgatgcattgtatagtcgacagaggtacgttcttggagacacagcaatgcagaagatggccaagtcccatgttttcttaagtgggatgggtggtcttggtttggaaattgcaaagaatcttgttcttgcagggattaaggcagttacaattcatgatacagaaaaatgccaagcatgggatctaggaaccaacttctttctcagtgaagatgatgttgttaataagagaaacagggctgaagctgtacttaaacatattgcagaactaaatccatacgttcatgtcacatcatcttctgttcctttcaatgagaccacagatctctcctttttagataaataccagtgtgtagtattgactgagatgaaacttccattgcagaagaagatcaatgacttttgccgttctcagtgccctccaattaagtttatcagtgcagatgtacatggaatttggtcaaggttattttgtgatttcggtgatgaatttgaagttttagatacaacaggagaagaaccaaaagaaattttcatttcaaacataacgcaagcaaatcctggcattgttacttgccttgaaaatcatcctcacaaactggagacaggacaattcctaacatttcgagaaattaatggaatgacaggtttaaatggatctatacaacaaataacggtgatatcgccattttcttttagtattggtgacaccacagaactggaaccatatttacatggaggcatagctgtccaagttaagactcctaaaacagttttttttgaatcactggagaggcagttaaaacatccaaagtgccttattgtggattttagcaaccctgaggcacctttagagattcacacagctatgcttgccttggaccagtttcaggagaaatacagtcgcaagccaaatgttggatgccaacaagattcagaagaactgttgaaactagcaacatctataagtgaaaccttggaagagaagcctgatgtaaatgctgacattgtgcattggctctcttggactgcccaaggctttttatctccacttgctgcagcagtaggaggtgttgccagccaagaagtattgaaagctgtaacaggaaaattttctcctttgtgccagtggttatatcttgaagcagcagatattgttgaatcactaggcaaacctgaatgtgaagaatttctcccacgaggagatagatatgatgccttaagagcttgcattggagacactttgtgtcagaaactgcaaaatttaaacatcttcttagtagggtgtggagccataggctgtgaaatgttgaaaaattttgctttacttggtgttggcacaagcaaagagaaaggaatgccatattttcttgatattagattacagttacagatcctgacttgatagagaaatccaacttaaatagacagttcctatttcgtcctcatcacatacagaaacctaaaagctacactgctgctgatgctactctgaaaataaattctcaaataaagatagatgcacacctgaacaaagtatgtccaaccactgagaccatttacaatgatgagttctatactaaacaagatgtaattattacagcattagataatgtggaagccaggagatacgtagacagtcgttgcttagcaaatctaaggcctcttttagattctggaacaatgggcactaagggacacactgaagttattgtaccgcatttgactgagtcttacaatagtcatcgggatcccccagaagaggaaataccattttgtactctaaaatcctttccagctgctattgaacacaccatacagtgggcaagagataagtttgaaagttccttttcccacaaaccttcattgtttaacaaattttggcaaacctattcatctgcagaagaagtcttacagaagatacagagtggacacagtttagaaggctgttttcaagttataaagttacttagcagaagacctagaaattggtcccagtgtgtagaattagcaagattaaagtttgaaaaatattttaaccataaggctcttcagcttcttcactgtttccctctggacatacgattaaaagatggcagtttattttggcagtcaccaaagaggccaccctctccaataaaatttgatttaaatgagcctttgcacctcagtttccttcagaatgctgcaaaactatatgctacagtatattgtattccatttgcagaagaggacttatcagcagatgccctcttgaatattctttcagaagtaaagattcaggaattcaagccttccaataaggttgttcaaacagatgaaactgcaaggaaaccagaccatgttcctattagcagtgaagatgagaggaatgcaattttccaactagaaaaggctattttatctaatgaagccaccaaaagtgaccttcagatggcagtgctttcatttgaaaaagatgatgatcataatggacacatagatttcatcacagctgcatcaaatcttcgtgccaaaatgtacagcattgaaccagctgaccgtttcaaaacaaagcgcatagctggtaaaattatacctgctatagcaacaaccactgctacagtttctggcttggttgccttggagatgatcaaagtaactggtggctatccatttgaagcttacaaaaattgttttcttaacttagccattccaattgtagtatttacagagacaactgaagtaaggaaaactaaaatcagaaatggaatatcatttacaatttgggatcgatggaccgtacatggaaaagaagatttcaccctcttggatttcataaatgcagtcaaagagaagtatggaattgagccaacaatggtggtacagggagtcaaaatgctttatgttcctgtaatgcctggtcatgcaaaaagattgaagttaacaatgcataaacttgtaaaacctactactgaaaagaaatatgtggatcttactgtgtcatttgctccagacattgatggagatgaagatttgccgggacctccagtaagatactacttcagtcatgacactgattaatacaagttgtcttaacgttactccaggaccacttgattttggaaagagtgcacttaattcagaagctaaagaaaatcagttcataatactatggatttctctttcattaagccttaattttaagggaaacatcagtaagaaactgcactgaagaattataaaacattttggggcatagcatacacttgtctaacggttcacacgtggctatgatcacaagcaactttgaactggaatgctatttacaaaagttttgtgtattaatctgtgtattaatctctctggataaaaagaaggaaaaaatatgtatgaccagaacagatatggatgaagaaattgaaagcaacgaatgcaactattcaaaaagtttaattttatgaatttcttttttgtttagtcttgaagactgattttctatgcaaatagtgtttggcatcctgcacctctgatatgatttggctttgagaatttaataccactgggaagaagtatggtagtggtggatgaagggtggatattttaaattgtgcagttacagtttactgtcctattacctctgctcgtttaaccagtttgttatatcactgtgtccccaaaatcaggatttttgttgatagcatcagtgttgtaggagcaataggtcagatgagacatattaacttagactaaacgtgaacagtattatatggactctcacaacgctcttagagaatccgtgaatgtgaacagacaaatgtggctaaccatttgattcttcagtatgccttctaatgtggctattttatttatgtgagactctaaacctgattgtcctaatatataaaactaaaagattttgtaaagggagtgtctttagaaatagatgaaatgtagaatgttaaaaattattgctagggtagtcttttttttccagaaacctaattagggtattaaattttgtgttttttttttttttttttttttaaacagaagcatgttatttcattcccattcccagaaagggagttaatgaagataaaaatttattttttaaggtctttattgagagaaactttgttttctgatatgaactattgcagatgtttttataaatactttcattaaaatgatgtaaacagtagtacccaacactgtaaactcagtgaaaatagtaaatgattcttttattactaagactgtcatgcattctgaagcagttggcttttttttaaccataggaagtcatttccctctagctcctttccttctactctcctgctcagaccattagtaggtactttgttaaataaaaaactagattaacatcaatattactccaatttggtatcttttacactatgtattatacctactttctttttatttcatttacaaatagtttaaattactttatcaaccagctgtattgtttccctcttgtaaaagtaccatcaagtggggaaaatgtatgtggaagtggagagtgaatttgtatgactaaaggataatctgtacatggggaagtgggcaaaagtggataggatgaatttaaagaaaatgactacctttggaaaaaagaaattaaattttgttcacatatcctaccctttcccattgtgcatatcccaagtgtcatatttaaaactaaggttacttaaaacagaatccaggaatatcaaggctctgtggcttggaattttagaggataggactaataaaaggacttttgcaaagaaggcttttttccacgttcactttgttttgtgttctttgaaagtaactgatacttttcgggtagttaattcagcagtccataaatatgatccagtaacttgcttatattttattgaagtctcgacagctcttcagaagtaaatttagaacgatgctgtcagttcatatttatagatattagtgttttagcagataaaacaaaatcaacaaaaattaagttcattttgtgattaaacctgcaaccatttttccattactttttttctatagttaatggttattgccatgatttcttctgtttggttctactaagctagaaagccagggtgaagttaatgataattcccattattttatttctgtaccatgagattgctgttgatgactgaaataccaggtgcaaaaattaatgatttgatttttgtacagtttcaatgagtattttttacttattaaaaataaattaagaaatgtaagaatatctttgtaaatcatgtttcataagttgactccagagattctgattttgctgtttattttgtgagtaatgttgctttggtgtttcctgattttcaagtttgcaatcatggagatacagcagttattaggtgtggaaggacattacctcaaatgtcctcagatggctccaggaaattcttttaaaacagttggagagaaatagtcgtgaccatgtaaaacctagaggatctggtaaatcccatactactggttagggatttgtaaagtccatttctttttagagttcaaagcagttctgttacttgtccataagttcctcataaattgtcccaaaggtaggacatggaaataaatgtatatctttattttttaatctactatgtcacactctggtgatattcatggaacattaaaaaagcaactatgtttattttataattagtaaaatgaagatagaaaattgttcttttgaaatttttagggaaaaaaaaaatctcgtgacctaaatctttccactataatgaatattcattgtgattgcaaatatctaattttatataatcactgtgtatggatttagcgattttacttttcatagattcaaaaacatataatctgaatgctttctctgaaaaaaaaaaaaatcagagttgagctcttgaggatcagagttaagtatccattgataatatgtgttcattttgctctatgtcataactttgtttttttattgagaaatatatatttttcaaaaacacatatatattcaaaaatacataaaatataaatatgcagttcaaggaataattttaaagcaactatataactagcactcagcttagtagaatatattgacagcagttcagaaattacacatgtagttccttcccagtcacaaccagctccctgccacgtaccctttggtaattaccactatcctaccttgtatgataatgtctctttgtttttatagtgttaccacctatgtgtgtaaacttaaacaatacagtttgcttgtttttgagttttatttaaaatcatacattcttttgtagctgcatttgttcaagatgggattgattcatgttggttgtagctgtactttattcttcattatgtctgtgtaatttacttttctgttaatatgccacaatttatttactgtagacaattgggatgtttttagtttcaggcaattacagtttcacaatgaacatcattttatgtaactcctagtacaaagagtatatatttaggagtagaattttttggtcatagggtattcatatcttaaattttattagatgattacaaatttttttctaagcattagta

SEQ ID NO: 307855 - DNA, 4783 bp, Homo sapiens
cggtcccgccccttcctaccttccagtagccggcggcggtgtctcaggcggcaatggaaggatccgagcctgtggccgcccatcagggggaagaggcgtcctgttcttcctgggggactggcagcacaaataaaaatttgcccattatgtcaacagcatctgtggaaatcgatgatgcattgtatagtcgacagaggtacgttcttggagacacagcaatgcagaagatggccaagtcccatgttttcttaagtgggatgggtggtcttggtttggaaattgcaaagaatcttgttcttgcagggattaaggcagttacaattcatgatacagaaaaatgccaagcatgggatctaggaaccaacttctttctcagtgaagatgatgttgttaataagagaaacagggctgaagctgtacttaaacatattgcagaactaaatccatacgttcatgtcacatcatcttctgttcctttcaatgagaccacagatctctcctttttagataaataccagtgtgtagtattgactgagatgaaacttccattgcagaagaagatcaatgacttttgccgttctcagtgccctccaattaagtttatcagtgcagatgtacatggaatttggtcaaggttattttgtgatttcggtgatgaatttgaagttttagatacaacaggagaagaaccaaaagaaattttcatttcaaacataacgcaagcaaatcctggcattgttacttgccttgaaaatcatcctcacaaactggagacaggacaattcctaacatttcgagaaattaatggaatgacaggtttaaatggatctatacaacaaataacggtgatatcgccattttcttttagtattggtgacaccacagaactggaaccatatttacatggaggcatagctgtccaagttaagactcctaaaacagttttttttgaatcactggagaggcagttaaaacatccaaagtgccttattgtggattttagcaaccctgaggcacctttagagattcacacagctatgcttgccttggaccagtttcaggagaaatacagtcgcaagccaaatgttggatgccaacaagattcagaagaactgttgaaactagcaacatctataagtgaaaccttggaagagaagcctgatgtaaatgctgacattgtgcattggctctcttggactgcccaaggctttttatctccacttgctgcagcagtaggaggtgttgccagccaagaagtattgaaagctgtaacaggaaaattttctcctttgtgccagtggttatatcttgaagcagcagatattgttgaatcactaggcaaacctgaatgtgaagaatttctcccacgaggagatagatatgatgccttaagagcttgcattggagacactttgtgtcagaaactgcaaaatttaaacatcttcttagtagggtgtggagccataggctgtgaaatgttgaaaaattttgctttacttggtgttggcacaagcaaagagaaaggaatgattacagttacagatcctgacttgatagagaaatccaacttaaatagacagttcctatttcgtcctcatcacatacagaaacctaaaagctacactgctgctgatgctactctgaaaataaattctcaaataaagatagatgcacacctgaacaaagtatgtccaaccactgagaccatttacaatgatgagttctatactaaacaagatgtaattattacagcattagataatgtggaagccaggagatacgtagacagtcgttgcttagcaaatctaaggcctcttttagattctggaacaatgggcactaagggacacactgaagttattgtaccgcatttgactgagtcttacaatagtcatcgggatcccccagaagaggaaataccattttgtactctaaaatcctttccagctgctattgaacacaccatacagtgggcaagagataagtttgaaagttccttttcccacaaaccttcattgtttaacaaattttggcaaacctattcatctgcagaagaagtcttacagaagatacagagtggacacagtttagaaggctgttttcaagttataaagttacttagcagaagacctagaaattggtcccagtgtgtagaattagcaagattaaagtttgaaaaatattttaaccataaggctcttcagcttcttcactgtttccctctggacatacgattaaaagatggcagtttattttggcagtcaccaaagaggccaccctctccaataaaatttgatttaaatgagcctttgcacctcagtttccttcagaatgctgcaaaactatatgctacagtatattgtattccatttgcagaagaggacttatcagcagatgccctcttgaatattctttcagaagtaaagattcaggaattcaagccttccaataaggttgttcaaacagatgaaactgcaaggaaaccagaccatgttcctattagcagtgaagatgagaggaatgcaattttccaactagaaaaggctattttatctaatgaagccaccaaaagtgaccttcagatggcagtgctttcatttgaaaaagatgatgatcataatggacacatagatttcatcacagctgcatcaaatcttcgtgccaaaatgtacagcattgaaccagctgaccgtttcaaaacaaagcgcatagctggtaaaattatacctgctatagcaacaaccactgctacagtttctggcttggttgccttggagatgatcaaagtaactggtggctatccatttgaagcttacaaaaattgttttcttaacttagccattccaattgtagtatttacagagacaactgaagtaaggaaaactaaaatcagaaatggaatatcatttacaatttgggatcgatggaccgtacatggaaaagaagatttcaccctcttggatttcataaatgcagtcaaagagaagtatggaattgagccaacaatggtggtacagggagtcaaaatgctttatgttcctgtaatgcctggtcatgcaaaaagattgaagttaacaatgcataaacttgtaaaacctactactgaaaagaaatatgtggatcttactgtgtcatttgctccagacattgatggagatgaagatttgccgggacctccagtaagatactacttcagtcatgacactgattaatacaagttgtcttaacgttactccaggaccacttgattttggaaagagtgcacttaattcagaagctaaagaaaatcagttcataatactatggatttctctttcattaagccttaattttaagggaaacatcagtaagaaactgcactgaagaattataaaacattttggggcatagcatacacttgtctaacggttcacacgtggctatgatcacaagcaactttgaactggaatgctatttacaaaagttttgtgtattaatctgtgtattaatctctctggataaaaagaaggaaaaaatatgtatgaccagaacagatatggatgaagaaattgaaagcaacgaatgcaactattcaaaaagtttaattttatgaatttcttttttgtttagtcttgaagactgattttctatgcaaatagtgtttggcatcctgcacctctgatatgatttggctttgagaatttaataccactgggaagaagtatggtagtggtggatgaagggtggatattttaaattgtgcagttacagtttactgtcctattacctctgctcgtttaaccagtttgttatatcactgtgtccccaaaatcaggatttttgttgatagcatcagtgttgtaggagcaataggtcagatgagacatattaacttagactaaacgtgaacagtattatatggactctcacaacgctcttagagaatccgtgaatgtgaacagacaaatgtggctaaccatttgattcttcagtatgccttctaatgtggctattttatttatgtgagactctaaacctgattgtcctaatatataaaactaaaagattttgtaaagggagtgtctttagaaatagatgaaatgtagaatgttaaaaattattgctagggtagtcttttttttccagaaacctaattagggtattaaattttgtgttttttttttttttttttttttaaacagaagcatgttatttcattcccattcccagaaagggagttaatgaagataaaaatttattttttaaggtctttattgagagaaactttgttttctgatatgaactattgcagatgtttttataaatactttcattaaaatgatgtaaacagtagtacccaacactgtaaactcagtgaaaatagtaaatgattcttttattactaagactgtcatgcattctgaagcagttggcttttttttaaccataggaagtcatttccctctagctcctttccttctactctcctgctcagaccattagtaggtactttgttaaataaaaaactagattaacatcaatattactccaatttggtatcttttacactatgtattatacctactttctttttatttcatttacaaatagtttaaattactttatcaaccagctgtattgtttccctcttgtaaaagtaccatcaagtggggaaaatgtatgtggaagtggagagtgaatttgtatgactaaaggataatctgtacatggggaagtgggcaaaagtagtcattttctttaaattcatcctatccacttttgcccacttccccatgtacagatt

SEQ ID NO: 307856 - DNA, 5722 bp, Homo sapiens
gtttatggcagttgagaaaattaaagttagggtgttctgttttgagttgtagatgccaacaagattcagaagaactgttgaaactagcaacatctataagtgaaaccttggaagagaagcctgatgtaaatgctgacattgtgcattggctctcttggactgcccaaggctttttatctccacttgctgcagcagtaggaggtgttgccagccaagaagtattgaaagctgtaacaggaaaattttctcctttgtgccagtggttatatcttgaagcagcagatattgttgaatcactaggcaaacctgaatgtgaagaatttctcccacgaggagatagatatgatgccttaagagcttgcattggagacactttgtgtcagaaactgcaaaatttaaacatcttcttagtagggtgtggagccataggctgtgaaatgttgaaaaattttgctttacttggtgttggcacaagcaaagagaaaggaatgccatattttcttgatattagattacagttacagatcctgacttgatagagaaatccaacttaaatagacagttcctatttcgtcctcatcacatacagaaacctaaaagctacactgctgctgatgctactctgaaaataaattctcaaataaagatagatgcacacctgaacaaagtatgtccaaccactgagaccatttacaatgatgagttctatactaaacaagatgtaattattacagcattagataatgtggaagccaggagatacgtagacagtcgttgcttagcaaatctaaggcctcttttagattctggaacaatgggcactaagggacacactgaagttattgtaccgcatttgactgagtcttacaatagtcatcgggatcccccagaagaggaaataccattttgtactctaaaatcctttccagctgctattgaacacaccatacagtgggcaagagataagtttgaaagttccttttcccacaaaccttcattgtttaacaaattttggcaaacctattcatctgcagaagaagtcttacagaagatacagagtggacacagtttagaaggctgttttcaagttataaagttacttagcagaagacctagaaattggtcccagtgtgtagaattagcaagattaaagtttgaaaaatattttaaccataaggctcttcagcttcttcactgtttccctctggacatacgattaaaagatggcagtttattttggcagtcaccaaagaggccaccctctccaataaaatttgatttaaatgagcctttgcacctcagtttccttcagaatgctgcaaaactatatgctacagtatattgtattccatttgcagaagaggacttatcagcagatgccctcttgaatattctttcagaagtaaagattcaggaattcaagccttccaataaggttgttcaaacagatgaaactgcaaggaaaccagaccatgttcctattagcagtgaagatgagaggaatgcaattttccaactagaaaaggctattttatctaatgaagccaccaaaagtgaccttcagatggcagtgctttcatttgaaaaagatgatgatcataatggacacatagatttcatcacagctgcatcaaatcttcgtgccaaaatgtacagcattgaaccagctgaccgtttcaaaacaaagcgcatagctggtaaaattatacctgctatagcaacaaccactgctacagtttctggcttggttgccttggagatgatcaaagtaactggtggctatccatttgaagcttacaaaaattgttttcttaacttagccattccaattgtagtatttacagagacaactgaagtaaggaaaactaaaatcagaaatggaatatcatttacaatttgggatcgatggaccgtacatggaaaagaagatttcaccctcttggatttcataaatgcagtcaaagagaagtatggaattgagccaacaatggtggtacagggagtcaaaatgctttatgttcctgtaatgcctggtcatgcaaaaagattgaagttaacaatgcataaacttgtaaaacctactactgaaaagaaatatgtggatcttactgtgtcatttgctccagacattgatggagatgaagatttgccgggacctccagtaagatactacttcagtcatgacactgattaatacaagttgtcttaacgttactccaggaccacttgattttggaaagagtgcacttaattcagaagctaaagaaaatcagttcataatactatggatttctctttcattaagccttaattttaagggaaacatcagtaagaaactgcactgaagaattataaaacattttggggcatagcatacacttgtctaacggttcacacgtggctatgatcacaagcaactttgaactggaatgctatttacaaaagttttgtgtattaatctgtgtattaatctctctggataaaaagaaggaaaaaatatgtatgaccagaacagatatggatgaagaaattgaaagcaacgaatgcaactattcaaaaagtttaattttatgaatttcttttttgtttagtcttgaagactgattttctatgcaaatagtgtttggcatcctgcacctctgatatgatttggctttgagaatttaataccactgggaagaagtatggtagtggtggatgaagggtggatattttaaattgtgcagttacagtttactgtcctattacctctgctcgtttaaccagtttgttatatcactgtgtccccaaaatcaggatttttgttgatagcatcagtgttgtaggagcaataggtcagatgagacatattaacttagactaaacgtgaacagtattatatggactctcacaacgctcttagagaatccgtgaatgtgaacagacaaatgtggctaaccatttgattcttcagtatgccttctaatgtggctattttatttatgtgagactctaaacctgattgtcctaatatataaaactaaaagattttgtaaagggagtgtctttagaaatagatgaaatgtagaatgttaaaaattattgctagggtagtcttttttttccagaaacctaattagggtattaaattttgtgttttttttttttttttttttttaaacagaagcatgttatttcattcccattcccagaaagggagttaatgaagataaaaatttattttttaaggtctttattgagagaaactttgttttctgatatgaactattgcagatgtttttataaatactttcattaaaatgatgtaaacagtagtacccaacactgtaaactcagtgaaaatagtaaatgattcttttattactaagactgtcatgcattctgaagcagttggcttttttttaaccataggaagtcatttccctctagctcctttccttctactctcctgctcagaccattagtaggtactttgttaaataaaaaactagattaacatcaatattactccaatttggtatcttttacactatgtattatacctactttctttttatttcatttacaaatagtttaaattactttatcaaccagctgtattgtttccctcttgtaaaagtaccatcaagtggggaaaatgtatgtggaagtggagagtgaatttgtatgactaaaggataatctgtacatggggaagtgggcaaaagtggataggatgaatttaaagaaaatgactacctttggaaaaaagaaattaaattttgttcacatatcctaccctttcccattgtgcatatcccaagtgtcatatttaaaactaaggttacttaaaacagaatccaggaatatcaaggctctgtggcttggaattttagaggataggactaataaaaggacttttgcaaagaaggcttttttccacgttcactttgttttgtgttctttgaaagtaactgatacttttcgggtagttaattcagcagtccataaatatgatccagtaacttgcttatattttattgaagtctcgacagctcttcagaagtaaatttagaacgatgctgtcagttcatatttatagatattagtgttttagcagataaaacaaaatcaacaaaaattaagttcattttgtgattaaacctgcaaccatttttccattactttttttctatagttaatggttattgccatgatttcttctgtttggttctactaagctagaaagccagggtgaagttaatgataattcccattattttatttctgtaccatgagattgctgttgatgactgaaataccaggtgcaaaaattaatgatttgatttttgtacagtttcaatgagtattttttacttattaaaaataaattaagaaatgtaagaatatctttgtaaatcatgtttcataagttgactccagagattctgattttgctgtttattttgtgagtaatgttgctttggtgtttcctgattttcaagtttgcaatcatggagatacagcagttattaggtgtggaaggacattacctcaaatgtcctcagatggctccaggaaattcttttaaaacagttggagagaaatagtcgtgaccatgtaaaacctagaggatctggtaaatcccatactactggttagggatttgtaaagtccatttctttttagagttcaaagcagttctgttacttgtccataagttcctcataaattgtcccaaaggtaggacatggaaataaatgtatatctttattttttaatctactatgtcacactctggtgatattcatggaacattaaaaaagcaactatgtttattttataattagtaaaatgaagatagaaaattgttcttttgaaatttttagggaaaaaaaaaatctcgtgacctaaatctttccactataatgaatattcattgtgattgcaaatatctaattttatataatcactgtgtatggatttagcgattttacttttcatagattcaaaaacatataatctgaatgctttctctgaaaaaaaaaaaaatcagagttgagctcttgaggatcagagttaagtatccattgataatatgtgttcattttgctctatgtcataactttgtttttttattgagaaatatatatttttcaaaaacacatatatattcaaaaatacataaaatataaatatgcagttcaaggaataattttaaagcaactatataactagcactcagcttagtagaatatattgacagcagttcagaaattacacatgtagttccttcccagtcacaaccagctccctgccacgtaccctttggtaattaccactatcctaccttgtatgataatgtctctttgtttttatagtgttaccacctatgtgtgtaaacttaaacaatacagtttgcttgtttttgagttttatttaaaatcatacattcttttgtagctgcatttgttcaagatgggattgattcatgttggttgtagctgtactttattcttcattatgtctgtgtaatttacttttctgttaatatgccacaatttatttactgtagacaattgggatgtttttagtttcaggcaattacagtttcacaatgaacatcattttatgtaactcctagtacaaagagtatatatttaggagtagaattttttggtcatagggtattcatatcttaaattttattagatgattacaaatttttttctaagcattagta

SEQ ID NO: 307857 - DNA, 6686 bp, Homo sapiens
cggtcccgccccttcctaccttccagtagccggcggcggtgtctcaggcggcaatggaaggatccgagcctgtggccgcccatcagggggaagaggcgtcctgttcttcctgggggactggcagcacaaataaaaatttgcccattatgtcaacagcatctgtggaaatcgatgatgcattgtatagtcgacagaggtacgttcttggagacacagcaatgcagaagatggccaagtcccatgttttcttaagtgggatgggtggtcttggtttggaaattgcaaagaatcttgttcttgcagggattaaggcagttacaattcatgatacagaaaaatgccaagcatgggatctaggaaccaacttctttctcagtgaagatgatgttgttaataagagaaacagggctgaagctgtacttaaacatattgcagaactaaatccatacgttcatgtcacatcatcttctgttcctttcaatgagaccacagatctctcctttttagataaataccagtgtgtagtattgactgagatgaaacttccattgcagaagaagatcaatgacttttgccgttctcagtgccctccaattaagtttatcagtgcagatgtacatggaatttggtcaaggttattttgtgatttcggtgatgaatttgaagttttagatacaacaggagaagaaccaaaagaaattttcatttcaaacataacgcaagcaaatcctggcattgttacttgccttgaaaatcatcctcacaaactggagacaggacaattcctaacatttcgagaaattaatggaatgacaggtttaaatggatctatacaacaaataacggtgatatcgccattttcttttagtattggtgacaccacagaactggaaccatatttacatggaggcatagctgtccaagttaagactcctaaaacagttttttttgaatcactggagaggcagttaaaacatccaaagtgccttattgtggattttagcaaccctgaggcacctttagagattcacacagctatgcttgccttggaccagtttcaggagaaatacagtcgcaagccaaatgttggatgccaacaagattcagaagaactgttgaaactagcaacatctataagtgaaaccttggaagagaagcctgatgtaaatgctgacattgtgcattggctctcttggactgcccaaggctttttatctccacttgctgcagcagtaggaggtgttgccagccaagaagtattgaaagctgtaacaggaaaattttctcctttgtgccagtggttatatcttgaagcagcagatattgttgaatcactaggcaaacctgaatgtgaagaatttctcccacgaggagatagatatgatgccttaagagcttgcattggagacactttgtgtcagaaactgcaaaatttaaacatcttcttagtagggtgtggagccataggctgtgaaatgttgaaaaattttgctttacttggtgttggcacaagcaaagagaaaggaatgattacagttacagatcctgacttgatagagaaatccaacttaaatagacagttcctatttcgtcctcatcacatacagaaacctaaaagctacactgctgctgatgctactctgaaaataaattctcaaataaagatagatgcacacctgaacaaagtatgtccaaccactgagaccatttacaatgatgagttctatactaaacaagatgtaattattacagcattagataatgtggaagccaggagatacgtagacagtcgttgcttagcaaatctaaggcctcttttagattctggaacaatgggcactaagggacacactgaagttattgtaccgcatttgactgagtcttacaatagtcatcgggatcccccagaagaggaaataccattttgtactctaaaatcctttccagctgctattgaacacaccatacagtgggcaagagataagtttgaaagttccttttcccacaaaccttcattgtttaacaaattttggcaaacctattcatctgcagaagaagtcttacagaagatacagagtggacacagtttagaaggctgttttcaagttataaagttacttagcagaagacctagaaattggtcccagtgtgtagaattagcaagattaaagtttgaaaaatattttaaccataaggctcttcagcttcttcactgtttccctctggacatacgattaaaagatggcagtttattttggcagtcaccaaagaggccaccctctccaataaaatttgatttaaatgagcctttgcacctcagtttccttcagaatgctgcaaaactatatgctacagtatattgtattccatttgcagaagaggacttatcagcagatgccctcttgaatattctttcagaagtaaagattcaggaattcaagccttccaataaggttgttcaaacagatgaaactgcaaggaaaccagaccatgttcctattagcagtgaagatgagaggaatgcaattttccaactagaaaaggctattttatctaatgaagccaccaaaagtgaccttcagatggcagtgctttcatttgaaaaagatgatgatcataatggacacatagatttcatcacagctgcatcaaatcttcgtgccaaaatgtacagcattgaaccagctgaccgtttcaaaacaaagcgcatagctggtaaaattatacctgctatagcaacaaccactgctacagtttctggcttggttgccttggagatgatcaaagtaactggtggctatccatttgaagcttacaaaaattgttttcttaacttagccattccaattgtagtatttacagagacaactgaagtaaggaaaactaaaatcagaaatggaatatcatttacaatttgggatcgatggaccgtacatggaaaagaagatttcaccctcttggatttcataaatgcagtcaaagagaagtatggaattgagccaacaatggtggtacagggagtcaaaatgctttatgttcctgtaatgcctggtcatgcaaaaagattgaagttaacaatgcataaacttgtaaaacctactactgaaaagaaatatgtggatcttactgtgtcatttgctccagacattgatggagatgaagatttgccgggacctccagtaagatactacttcagtcatgacactgattaatacaagttgtcttaacgttactccaggaccacttgattttggaaagagtgcacttaattcagaagctaaagaaaatcagttcataatactatggatttctctttcattaagccttaattttaagggaaacatcagtaagaaactgcactgaagaattataaaacattttggggcatagcatacacttgtctaacggttcacacgtggctatgatcacaagcaactttgaactggaatgctatttacaaaagttttgtgtattaatctgtgtattaatctctctggataaaaagaaggaaaaaatatgtatgaccagaacagatatggatgaagaaattgaaagcaacgaatgcaactattcaaaaagtttaattttatgaatttcttttttgtttagtcttgaagactgattttctatgcaaatagtgtttggcatcctgcacctctgatatgatttggctttgagaatttaataccactgggaagaagtatggtagtggtggatgaagggtggatattttaaattgtgcagttacagtttactgtcctattacctctgctcgtttaaccagtttgttatatcactgtgtccccaaacatattaacttagactaaacgtgaacagtattatatggactctcacaacgctcttagagaatccgtgaatgtgaacagacaaatgtggctaaccatttgattcttcagtatgccttctaatgtggctattttatttatgtgagactctaaacctgattgtcctaatatataaaactaaaagattttgtaaagggagtgtctttagaaatagatgaaatgtagaatgttaaaaattattgctagggtagtcttttttttccagaaacctaattagggtattaaattttgtgttttttttttttttttttttttaaacagaagcatgttatttcattcccattcccagaaagggagttaatgaagataaaaatttattttttaaggtctttattgagagaaactttgttttctgatatgaactattgcagatgtttttataaatactttcattaaaatgatgtaaacagtagtacccaacactgtaaactcagtgaaaatagtaaatgattcttttattactaagactgtcatgcattctgaagcagttggcttttttttaaccataggaagtcatttccctctagctcctttccttctactctcctgctcagaccattagtaggtactttgttaaataaaaaactagattaacatcaatattactccaatttggtatcttttacactatgtattatacctactttctttttatttcatttacaaatagtttaaattactttatcaaccagctgtattgtttccctcttgtaaaagtaccatcaagtggggaaaatgtatgtggaagtggagagtgaatttgtatgactaaaggataatctgtacatggggaagtgggcaaaagtggataggatgaatttaaagaaaatgactacctttggaaaaaagaaattaaattttgttcacatatcctaccctttcccattgtgcatatcccaagtgtcatatttaaaactaaggttacttaaaacagaatccaggaatatcaaggctctgtggcttggaattttagaggataggactaataaaaggacttttgcaaagaaggcttttttccacgttcactttgttttgtgttctttgaaagtaactgatacttttcgggtagttaattcagcagtccataaatatgatccagtaacttgcttatattttattgaagtctcgacagctcttcagaagtaaatttagaacgatgctgtcagttcatatttatagatattagtgttttagcagataaaacaaaatcaacaaaaattaagttcattttgtgattaaacctgcaaccatttttccattactttttttctatagttaatggttattgccatgatttcttctgtttggttctactaagctagaaagccagggtgaagttaatgataattcccattattttatttctgtaccatgagattgctgttgatgactgaaataccaggtgcaaaaattaatgatttgatttttgtacagtttcaatgagtattttttacttattaaaaataaattaagaaatgtaagaatatctttgtaaatcatgtttcataagttgactccagagattctgattttgctgtttattttgtgagtaatgttgctttggtgtttcctgattttcaagtttgcaatcatggagatacagcagttattaggtgtggaaggacattacctcaaatgtcctcagatggctccaggaaattcttttaaaacagttggagagaaatagtcgtgaccatgtaaaacctagaggatctggtaaatcccatactactggttagggatttgtaaagtccatttctttttagagttcaaagcagttctgttacttgtccataagttcctcataaattgtcccaaaggtaggacatggaaataaatgtatatctttattttttaatctactatgtcacactctggtgatattcatggaacattaaaaaagcaactatgtttattttataattagtaaaatgaagatagaaaattgttcttttgaaatttttagggaaaaaaaaaatctcgtgacctaaatctttccactataatgaatattcattgtgattgcaaatatctaattttatataatcactgtgtatggatttagcgattttacttttcatagattcaaaaacatataatctgaatgctttctctgaaaaaaaaaaaaatcagagttgagctcttgaggatcagagttaagtatccattgataatatgtgttcattttgctctatgtcataactttgtttttttattgagaaatatatatttttcaaaaacacatatatattcaaaaatacataaaatataaatatgcagttcaaggaataattttaaagcaactatataactagcactcagcttagtagaatatattgacagcagttcagaaattacacatgtagttccttcccagtcacaaccagctccctgccacgtaccctttggtaattaccactatcctaccttgtatgataatgtctctttgtttttatagtgttaccacctatgtgtgtaaacttaaacaatacagtttgcttgtttttgagttttatttaaaatcatacattcttttgtagctgcatttgttcaagatgggattgattcatgttggttgtagctgtactttattcttcattatgtctgtgtaatttacttttctgttaatatgccacaatttatttactgtagacaattgggatgtttttagtttcaggcaattacagtttcacaatgaacatcattttatgtaactcctagtacaaagagtatatatttaggagtagaattttttggtcatagggtattcatatcttaaattttattagatgattacaaatttttttctaagcattagta

SEQ ID NO: 307858 - DNA, 2836 bp, Homo sapiens
cggtcccgccccttcctaccttccagtagccggcggcggtgtctcaggcggcaatggaaggatccgagcctgtggccgcccatcagggggaagaggcgtcctgttcttcctgggggactggcagcacaaataaaaatttgcccattatgtcaacagcatctgtggaaatcgatgatgcattgtatagtcgacagaggtacgttcttggagacacagcaatgcagaagatggccaagtcccatgttttcttaagtgggatgggtggtcttggtttggaaattggtaagcaatatttatattcctaatttttgacacttttgagcaatgaagatagtttaaataacttaacttcatccccttatatttcctataaaggaagttagatccaaaatgttgatcagattgagtttttaatctttgtcaagactatttcgtgatgttatattcttccacaaagaaccaataatgactcattgcttctttttgtgatgttaatagccattaattatcattctctatatccattaattcattataagcacacatacatatactgtattcataaaaacatatctggaagaatacgttgaaattttaggagtgattatctctgggtgttgtgattatgcacattttaattttttcacttttaacctgtattttgtaacttttttaagacaaggaacttgtattaagtagtaaaaaaagaagttaaaagtatgcagtcagatatgtgactaagctctgtgaagacatatctagtgtgtattcccaatattgagctattcctttttcttttgcctttctagcaaagaatcttgttcttgcagggattaaggtaagtaaatgtcctctgtaagaaaaattgttatgagccttttttttggctcatttgttatggtaatattgtttatactttgttttaattattgtctttaatgctctactttttaaaaaaaatcatggaaatttaaaaaatatacaaagaaagaattgtgtaacaaaaccccacatacccatcagaaagcatcagttaccaactcttggggacatttgtttcatatatcttcttcccattccttattgcccccaactgccaaattattttgatgtaaatttcagacattgtattatatcatccttaaatattttagtagtatctttaaaagataagaatatcttttgaagcagcaatataattttcacacctaaaatgtaacaagctcttaataccattgtattagtttacatgttgctataaaacagtttaccccaaaatttgtagcttaagcaacatttgttgtctcatagtttctgtgagtcaggattcgggcatgactctggttggggtttctctgggagtctcttacaaggctgcagtcaaggtattagcagggcctgcagtcatcttgaggctagactggggaaggatctgcttcccaagctggctcatgtggttcttggtaggatttagttcttcatgtattgttaaactgaggacctcagttcctgctggctcttgaccaaaggtcaccctcaattccttgcttgtatggctttctccatagggcagttcacagtgtggcagtttgcttcatcagagtaaacaagtaagacaggagaagagagtgtgttaacaagacaagtcagtcttttgtaacctaatctcagaagtgggtccaggccacactcaaggtgggagatcacacgaaagcctaaatactatgaagcaggaaacattgtggccatcttaaaagcctgtctaccacagtcatcaaatgtctagttagagttcaaattttcccaaatgtcttaagacattttattgaaagcttgtatcattctaatcaggatccaagtaaaattcgtatactgaacttggtttattttaatctatagatttcccttccttgcctaggttttttcttgcaatttatttgttgaagaaactagtcatttgtcacaggtatttctacatgtgtatttcctgtaaactggtagttatagccagagaatccagttcagatttgattctttttggcaagactgtttcatagctgttctcccatcaggagacagtaatattctgttgtctctctttttgtgattattattagctgttaattattattgcctagattcattatttcattaggggcagtgatgatgttttatcattcttttctcatttattagctggaattatattttagaaaaaaattccagtcatgactttcttggtttcacgaaagtatggattgtacatttacaaaatgcaggataaatactacatttttccccattaacttaccagttttcaaaatcagtggtttcctgtcatcatttcgtagtattgaccagtgaatttatatgtatgtgtacattatgataaactcatggatttaaacataatttgatgtgttttgatctattatagttattttcattgatgctcagattgttccatctttggttattgtggttctcttcctgttttttgaggctttgagacacagcccccagtagtctttgtcgctgtttacaaagtcttttcagtgggcagagctagaacgttcgtaatgagtaaatactgaaatttctgattttcaggtttaggcttataaagtattactaaaatttctaatttttactttggattataggatatttatttctgtgattttatatttgtatcttattaggattttggtttctaatgatccattacgtgctttatcctatatatgctatatattctttatcctattatattttacttgtatggcatagtttcagaataccaattccaatattgttaataataatgtattattga

SEQ ID NO: 307859 - DNA, 1164 bp, Homo sapiens
cggtcccgccccttcctaccttccagtagccggcggcggtgtctcaggcggcaatggaaggatccgagcctgtggccgcccatcagggggaagaggcgtcctgttcttcctgggggactggcagcacaaataaaaatttgcccattatgtcaacagcatctgtggaaatcgatgatgcattgtatagtcgacagaggtacgttcttggagacacagcaatgcagaagatggccaagtcccatgttttcttaagtgggatgggtggtcttggtttggaaattgcaaagaatcttgttcttgcagggattaaggcagttacaattcatgatacagaaaaatgccaagcatgggatctaggaaccaacttctttctcagtgaagatgatgttgttaataagagaaacagggctgaagctgtacttaaacatattgcagaactaaatccatacgttcatgtcacatcatcttctgttcctttcaatgagaccacagatctctcctttttagataaataccagtgtgtagtattgactgagatgaaacttccattgcagaagaagatcaatgacttttgccgttctcagtgccctccaattaagtttatcagtgcagatgtacatggaatttggtcaaggttattttgtgatttcggtgatgaatttgaagttttagatacaacaggagaagaaccaaaagaaattttcatttcaaacataacgcaagcaaatcctggcattgttacttgccttgaaaatcatcctcacaaactggagacaggacaattcctaacatttcgagaaattaatggaatgacaggtttaaatggatctatacaacaaataacggtgatatcgccattttcttttagtattggtgacaccacagaactggaaccatatttacatggaggcatagctgtccaagttaagactcctaaaacagttttttttgaatcactggagaggcagttaaaacatccaaagtgccttattgtggattttagcaaccctgaggcacctttagagattcacacagctatgcttgccttggaccagtttcaggagaaatacagtcgcaagccaaatgttgggtaatgttttaagtttaaaaataagtattttcctttttataaaagtagtagttcagaaattataatttaaaaag

SEQ ID NO: 307860 - DNA, 437 bp, Homo sapiens
agttccccacactcctcccagctcttcattaaaaaaaaaaaaaaacaaacaaacaaaaaaaaacactatgctggaattctttaattttgtaaattagggataattaacctcttatgacaataagagttgaaatttaaatatctatatccctgtgtaatgattttttaaattttttgtcttctagtgatatcgccattttcttttagtattggtgacaccacagaactggaaccatatttacatggaggcatagctgtccaagttaagactcctaaaacagttttttttgtaagtatttttttttcggcttaaaaaacatttttttacagaaaaagaaaggcagaagagacaaataactactcagttaaccaaacagattaaatgtggaacagaatttgtttttatttttatttttttgtttgtacccactttgaggg

SEQ ID NO: 307861 - DNA, 936 bp, Homo sapiens
agcgctttcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatgc

SEQ ID NO: 307862 - DNA, 1047 bp, Homo sapiens
agcgctttcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatgcaaaaaaaaaaaataacacaaaaaaaacgccgggactctatgcggggaaaaagtaagggaagaaaagtccacactttgaagggaacgcgccaaggaagaaaacgcaaaaaaa

SEQ ID NO: 307863 - DNA, 942 bp, Homo sapiens
  misc_feature (32)..(32): n is a, c, g, or t
aaaccttacggctaggtacgaggcctgggtgntgctaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatgc

SEQ ID NO: 307864 - DNA, 1076 bp, Homo sapiens
  misc_feature (32)..(32): n is a, c, g, or t
aaaccttacggctaggtacgaggcctgggtgntgctaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatgccaaaaaacaaaacccctccccttctcttcctacctctctcctacttcatccctaacctcctcctctatacaaaataacctcggggggggcccgtgccccaatccccctgggggcgctttcacattcggggcgcg

SEQ ID NO: 307865 - DNA, 599 bp, Homo sapiens
  misc_feature (23)..(23): n is a, c, g, or t
ggctggtccaggcctacgggtanatgcacgtctggccgatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatgc

SEQ ID NO: 307866 - DNA, 877 bp, Homo sapiens
  misc_feature (13)..(14): n is a, c, g, or t
  misc_feature (16)..(16): n is a, c, g, or t
  misc_feature (26)..(26): n is a, c, g, or t
  misc_feature (97)..(97): n is a, c, g, or t
ggagctaccaagnntntgattcaaanaaaccgcgacgcgcgttatttaaaacaacgacgcagtactatacgtctaggtacagctggtgcaatcggangaggaataagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggttcaacgccctgtccgaaagggtgcttggggcctgttccggcccgggtttccctttcgggtttgatctgcttccccg

SEQ ID NO: 307867 - DNA, 982 bp, Homo sapiens
  misc_feature (32)..(32): n is a, c, g, or t
  misc_feature (785)..(785): n is a, c, g, or t
  misc_feature (788)..(789): n is a, c, g, or t
aaaccttacggctaggtacgaggcctgggtgntgctcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatgcaaaaaaaaagaanaanncacaaaaggacagccagctcgggcgccccactcgaggggggcggccgccaacacgggcgcaacgacaggggacccagcgacacacacaggacaccagacaaagaagagagacaaaaaggagaaacaaggaagaacacacaagaggagagacaaaaaacgcagaaagcggagaacacgagataaggaccgagaa

SEQ ID NO: 307868 - DNA, 1010 bp, Homo sapiens
  misc_feature (13)..(14): n is a, c, g, or t
  misc_feature (16)..(16): n is a, c, g, or t
  misc_feature (26)..(26): n is a, c, g, or t
  misc_feature (97)..(97): n is a, c, g, or t
ggagctaccaagnntntgattcaaanaaaccgcgacgcgcgttatttaaaacaacgacgcagtactatacgtctaggtacagctggtgcaatcggangaggaataagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatgc

SEQ ID NO: 307869 - DNA, 1146 bp, Homo sapiens
  misc_feature (949)..(949): n is a, c, g, or t
  misc_feature (952)..(953): n is a, c, g, or t
agcgctttcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatgcaaaaaaaaagaanaanncacaaaaggacagccagctcgggcgccccactcgaggggggcggccgccaacacgggcgcaacgacaggggacccagcgacacacacaggacaccagacaaagaagagagacaaaaaggagaaacaaggaagaacacacaagaggagagacaaaaaacgcagaaagcggagaacacgagataaggaccgagaa

SEQ ID NO: 307870 - DNA, 1033 bp, Homo sapiens
agcgctttcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatgcaaaaacacatacgcagacagaaaaacactttttggggcgcaccgcaccaagaaaaagcttttaaaacctcttgtttggggcggcggcccccgtagtt

SEQ ID NO: 307871 - DNA, 969 bp, Homo sapiens
agcgctttcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatgcaaaaaaaaaacaaaacgaaaaaaaaacaacctc

SEQ ID NO: 307872 - DNA, 1070 bp, Homo sapiens
agcgctttcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatgccaaaaaacaaaacccctccccttctcttcctacctctctcctacttcatccctaacctcctcctctatacaaaataacctcggggggggcccgtgccccaatccccctgggggcgctttcacattcggggcgcg

SEQ ID NO: 307873 - DNA, 964 bp, Homo sapiens
agcgctttcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatgcaaaaaaagtcgacgcggccgcgaattta

SEQ ID NO: 307874 - DNA, 945 bp, Homo sapiens
agcgctttcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagaaccctggtttgtaataatccagccctcttgttttcttttctttcttcttg

SEQ ID NO: 307875 - DNA, 978 bp, Homo sapiens
  misc_feature (848)..(848): n is a, c, g, or t
  misc_feature (905)..(905): n is a, c, g, or t
  misc_feature (907)..(907): n is a, c, g, or t
  misc_feature (916)..(916): n is a, c, g, or t
  misc_feature (922)..(922): n is a, c, g, or t
agcgctttcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggtttgaatgaatacgatgcttatccaaatgnagtggcctactttaattgactggtagtcaagataagcctcttggaggataatctccngnaaaaaaaancgggtnttggggaaaggtgagccggtttgtccgccttggaggggggccctgggtatacgaga

SEQ ID NO: 307876 - DNA, 1122 bp, Homo sapiens
agcgctttcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcaggtgagtaatagggaaaaaattggtgacagacttgggaggtctttggcttacactaagctgggcttttctgggaggctcacccaggaaaattttctgggtggaaagttttggttggacagtacagctatttttaggaattgatccctttatgcttcacaattttattattctgtcttccttttttagtggctttgaatgaaatacagatgcattatccagaactgaagttgccctacttttaactttgaacttggctagttcaaagatagactcttcttttgtaaagtaaataaattcttcaaaatgc

SEQ ID NO: 307877 - DNA, 964 bp, Homo sapiens
  misc_feature (24)..(25): n is a, c, g, or t
  misc_feature (28)..(28): n is a, c, g, or t
  misc_feature (51)..(51): n is a, c, g, or t
  misc_feature (54)..(54): n is a, c, g, or t
  misc_feature (56)..(56): n is a, c, g, or t
atggcctttttatgggctgacacnntantagaaaaccacgtggtggttgtnaananaacagtgtacgtcgattccgggtgaacgtttgggtcgcgtcgattgggcggggtcgccgagtaagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatgc

SEQ ID NO: 307878 - DNA, 827 bp, Homo sapiens
  misc_feature (18)..(19): n is a, c, g, or t
  misc_feature (26)..(26): n is a, c, g, or t
gcagtctggtaccgcccnnggggtantggatatcgtcgacccacgcgctctgcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatgc

SEQ ID NO: 307879 - DNA, 803 bp, Homo sapiens
agcgctttcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggttcaacgccctgtccgaaagggtgcttggggcctgttccggcccgggtttccctttcgggtttgatctgcttccccg

SEQ ID NO: 307880 - DNA, 1122 bp, Homo sapiens
agcgctttcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccgggtgagggatgtgctgggaacctaattggcgggctctggctacttgcaatccctgggtctctatgctttgaagaacagattgccttacttgtgtgactcctattttcacattggggaagacctccacctgacctttcatttaaggacttaaggcgtgggcattattgaatgctctgctttcttccagtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatgc

SEQ ID NO: 307881 - DNA, 1308 bp, Homo sapiens
agcgctttcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccgggtgagggatgtgctgggaacctaattggcgggctctggctacttgcaatccctgggtctctatgctttgaagaacagattgccttacttgtgtgactcctattttcacattggggaagacctccacctgacctttcatttaaggacttaaggcgtgggcattattgaatgctctgctttcttccagtttcaaatcgccactgtcaccgaaaaaggtgttgaaatagagggaccattgtctacagagaccaactgggatattgcccacatgatcaggtgagtaatagggaaaaaattggtgacagacttgggaggtctttggcttacactaagctgggcttttctgggaggctcacccaggaaaattttctgggtggaaagttttggttggacagtacagctatttttaggaattgatccctttatgcttcacaattttattattctgtcttccttttttagtggctttgaatgaaatacagatgcattatccagaactgaagttgccctacttttaactttgaacttggctagttcaaagatagactcttcttttgtaaagtaaataaattcttcaaaatgc

SEQ ID NO: 307882 - DNA, 1190 bp, Homo sapiens
agcgctttcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgtaagtcatccagagaacaggagagtggttcccaagtagagaggggagtcccctgttttttattcccttcgatgggatggggggacttgttgcagcgggggactggaagagttgttggaggtgggcgatctgtgtttgcaataaagtttttggcattaggtgtaaaatgggggaaggtgtggtaacttcttttggggatgggtggagaccccgacttaattctctcccttttctcacaaccaattccttttaaggattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatgc

SEQ ID NO: 307883 - DNA, 759 bp, Homo sapiens
  misc_feature (736)..(736): n is a, c, g, or t
agcgctttcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggccccgccgaactttaattaaaaaacgcttgccattgccaaattgcctggttacttaacccgaaaaaacgccccgnttccttaacaaacccgggttttc

SEQ ID NO: 307884 - DNA, 1329 bp, Homo sapiens
agcgctttcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcaggtaagtagtaagtctagaggtgggggaaagggaagacaaaaggaaatggattagtggttgtctgcttttctcctgaaattctgatatgagggatgggctgggatcgctattactgggcagatggttttctttgtagtctgggggctgtaggtgttgacactgattccagtgacaagatgacatgactgggagtcagtagacatgcaaagagaggacaccctagaacttcttcctgaagtggctcttagcttattttctaagcagagttcattctggtgaggcaagaagtagaatgtcatctttcactctaatgctttttataccatagatttgagacaactagcctgttattcagcccaatatccccccatggttttcccccaatctccctagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatgc

SEQ ID NO: 307885 - DNA, 1111 bp, Homo sapiens
agcgctttcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagaggttcatatgaatacaaataacttatttcctttaccacccaacctagtacctgtgtagtatctcttctgtctcttctccccaagtgaatcccactttaactcagaccccatggtccccttcttcagctaagatgaacctaaggtgaaatgagttttgacccattgtgtcctgttagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatgc

SEQ ID NO: 307886 - DNA, 1211 bp, Homo sapiens
agcgctttcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcaggtaagtagtaagtctagaggtgggggaaagggaagacaaaaggaaatggattagtggttgtctgcttttctcctgaaattctgatatgagggatgggctgggatcgctattactgggcagatggttttctttgtagtctgggggctgtaggtgttgacactgattccagtgacaagatgacatgactgggagtcagtagacatgcaaagagaggacaccctagaacttcttcctgaagtggctcttagcttattttctaagcagagttcattctgcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatgc

SEQ ID NO: 307887 - DNA, 1504 bp, Homo sapiens
agcgctttcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagaggttcatatgaatacaaataacttatttcctttaccacccaacctagtacctgtgtagtatctcttctgtctcttctccccaagtgaatcccactttaactcagaccccatggtccccttcttcagctaagatgaacctaaggtgaaatgagttttgacccattgtgtcctgttagcttcctcggttatgtggacatgcttggtgtagcctatgaagccccttcgctggccactggttatggtgcatacttggctcaggtaagtagtaagtctagaggtgggggaaagggaagacaaaaggaaatggattagtggttgtctgcttttctcctgaaattctgatatgagggatgggctgggatcgctattactgggcagatggttttctttgtagtctgggggctgtaggtgttgacactgattccagtgacaagatgacatgactgggagtcagtagacatgcaaagagaggacaccctagaacttcttcctgaagtggctcttagcttattttctaagcagagttcattctggtgaggcaagaagtagaatgtcatctttcactctaatgctttttataccatagatttgagacaactagcctgttattcagcccaatatccccccatggttttcccccaatctccctagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatgc

SEQ ID NO: 307888 - DNA, 1386 bp, Homo sapiens
agcgctttcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagaggttcatatgaatacaaataacttatttcctttaccacccaacctagtacctgtgtagtatctcttctgtctcttctccccaagtgaatcccactttaactcagaccccatggtccccttcttcagctaagatgaacctaaggtgaaatgagttttgacccattgtgtcctgttagcttcctcggttatgtggacatgcttggtgtagcctatgaagccccttcgctggccactggttatggtgcatacttggctcaggtaagtagtaagtctagaggtgggggaaagggaagacaaaaggaaatggattagtggttgtctgcttttctcctgaaattctgatatgagggatgggctgggatcgctattactgggcagatggttttctttgtagtctgggggctgtaggtgttgacactgattccagtgacaagatgacatgactgggagtcagtagacatgcaaagagaggacaccctagaacttcttcctgaagtggctcttagcttattttctaagcagagttcattctgcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatgc

SEQ ID NO: 307889 - DNA, 1515 bp, Homo sapiens
agcgctttcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcaggtaagtagtaagtctagaggtgggggaaagggaagacaaaaggaaatggattagtggttgtctgcttttctcctgaaattctgatatgagggatgggctgggatcgctattactgggcagatggttttctttgtagtctgggggctgtaggtgttgacactgattccagtgacaagatgacatgactgggagtcagtagacatgcaaagagaggacaccctagaacttcttcctgaagtggctcttagcttattttctaagcagagttcattctggtgaggcaagaagtagaatgtcatctttcactctaatgctttttataccatagatttgagacaactagcctgttattcagcccaatatccccccatggttttcccccaatctccctagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcaggtgagtaatagggaaaaaattggtgacagacttgggaggtctttggcttacactaagctgggcttttctgggaggctcacccaggaaaattttctgggtggaaagttttggttggacagtacagctatttttaggaattgatccctttatgcttcacaattttattattctgtcttccttttttagtggctttgaatgaaatacagatgcattatccagaactgaagttgccctacttttaactttgaacttggctagttcaaagatagactcttcttttgtaaagtaaataaattcttcaaaatgc

SEQ ID NO: 307890 - DNA, 1357 bp, Homo sapiens
agcgctttcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcaggtaagtagtaagtctagaggtgggggaaagggaagacaaaaggaaatggattagtggttgtctgcttttctcctgaaattctgatatgagggatgggctgggatcgctattactgggcagatggttttctttgtagtctgggggctgtaggtgttgacactgattccagtgacaagatgacatgactgggagtcagtagacatgcaaagagaggacaccctagaacttcttcctgaagtggctcttagcttattttctaagcagagttcattctggtgaggcaagaagtagaatgtcatctttcactctaatgctttttataccatagatttgagacaactagcctgttattcagcccaatatccccccatggttttcccccaatctccctagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatgcacacaaaatccaacctcctcacctcaac

SEQ ID NO: 307891 - DNA, 1701 bp, Homo sapiens
agcgctttcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcaggtaagtagtaagtctagaggtgggggaaagggaagacaaaaggaaatggattagtggttgtctgcttttctcctgaaattctgatatgagggatgggctgggatcgctattactgggcagatggttttctttgtagtctgggggctgtaggtgttgacactgattccagtgacaagatgacatgactgggagtcagtagacatgcaaagagaggacaccctagaacttcttcctgaagtggctcttagcttattttctaagcagagttcattctggtgaggcaagaagtagaatgtcatctttcactctaatgctttttataccatagatttgagacaactagcctgttattcagcccaatatccccccatggttttcccccaatctccctagcctctgctgcgagaagttctggagaagcagccagtgctaagccagaccgaggcccgcgacttagtagaacgctgcatgcgagtgctgtactaccgagatgcccgttcttacaaccgggtgagggatgtgctgggaacctaattggcgggctctggctacttgcaatccctgggtctctatgctttgaagaacagattgccttacttgtgtgactcctattttcacattggggaagacctccacctgacctttcatttaaggacttaaggcgtgggcattattgaatgctctgctttcttccagtttcaaatcgccactgtcaccgaaaaaggtgttgaaatagagggaccattgtctacagagaccaactgggatattgcccacatgatcaggtgagtaatagggaaaaaattggtgacagacttgggaggtctttggcttacactaagctgggcttttctgggaggctcacccaggaaaattttctgggtggaaagttttggttggacagtacagctatttttaggaattgatccctttatgcttcacaattttattattctgtcttccttttttagtggctttgaatgaaatacagatgcattatccagaactgaagttgccctacttttaactttgaacttggctagttcaaagatagactcttcttttgtaaagtaaataaattcttcaaaatgc

SEQ ID NO: 307892 - DNA, 1244 bp, Homo sapiens
agcgctttcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcaggtaagtagtaagtctagaggtgggggaaagggaagacaaaaggaaatggattagtggttgtctgcttttctcctgaaattctgatatgagggatgggctgggatcgctattactgggcagatggttttctttgtagtctgggggctgtaggtgttgacactgattccagtgacaagatgacatgactgggagtcagtagacatgcaaagagaggacaccctagaacttcttcctgaagtggctcttagcttattttctaagcagagttcattctgcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatgcaaaaaaaaaacaaaacgaaaaaaaaacaacctc

SEQ ID NO: 307893 - DNA, 1365 bp, Homo sapiens
agcgctttcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgtaagtcatccagagaacaggagagtggttcccaagtagagaggggagtcccctgttttttattcccttcgatgggatggggggacttgttgcagcgggggactggaagagttgttggaggtgggcgatctgtgtttgcaataaagtttttggcattaggtgtaaaatgggggaaggtgtggtaacttcttttggggatgggtggagaccccgacttaattctctcccttttctcacaaccaattccttttaaggattgatgaggagcttctgggagatggacacagctatagtcctagagctattcattcatggctgaccagggccatgtacagccggcgctcgaagatgaaccctttgtggaacaccatggtcatcggaggctatgctgatggagagaggttcatatgaatacaaataacttatttcctttaccacccaacctagtacctgtgtagtatctcttctgtctcttctccccaagtgaatcccactttaactcagaccccatggtccccttcttcagctaagatgaacctaaggtgaaatgagttttgacccattgtgtcctgttagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatgc

SEQ ID NO: 307894 - DNA, 569 bp, Homo sapiens
agcgctttcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtgacacgaatgtaacaggtgccgagctc

SEQ ID NO: 307895 - DNA, 665 bp, Homo sapiens
  misc_feature (543)..(543): n is a, c, g, or t
agcgctttcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtngcgacattgctttttggtggttaaggcccccttaaatttggaaaaagggcccccccccttttttccgggccttgggggggccccaaaccttgggggttttttaaattgggggggttgggcca

SEQ ID NO: 307896 - DNA, 557 bp, Homo sapiens
agcgctttcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcatcctcgctcctgatatcgcgttcctccg

SEQ ID NO: 307897 - DNA, 239 bp, Homo sapiens
ggacgcaagaacataacaggaatgggcaactatggaagtatttgtgtgtggaaggccctaacctggccctgtcctccctgtctctacatttggaataacttgttcctatttcaggaaagggaaatggtgtcactcaggccctgggactgcttctccagccaggctggggccacaggtcccactctagtgaaggtcaatgtctcagaataaaagctgtatttttacaaaaaaaaaaaagt

SEQ ID NO: 307898 - DNA, 2531 bp, Homo sapiens
ggatgggctactggaggagctcctgggagttgggcctcaggtaaggagagccgtgctgggtttgggggtggcatggagtcaagggtggacagggcctcctggtcctgagtcacaatgctgtgcctacaggtggaggagttctctgtggagccacccctggatgacctgtctctggatgaggcacagtttgtcttggcccccagctgctgttccgtggactccgctggccccaggcctgaagttgaggaggaaaatggggaggaagttttcctgagtgcctatgatgacctaagtccccttctgggacctaaacccccaatctggaagggttcagggagtctggagggagaggcagcaggatgtggaaggcaggctctgggacagggtggggaagagcaggcatgctgggaagttggggaggacaagcaggctgagcctggaggcaggctagacatcagggaagaggcagagggaagtccagagaccaaggtggaggctggaaaggccagtgaggatagaggggaggctgggggaagccaagagacaaaagtcagattgagagaagggagtagggaagagacagaggccaaggaagagaagtccaaaggtcagaagaaggctgacagtatggaggctaaaggtgtggaggaaccaggaggagatgagtatacagatgagaaggaaaaagaaattgagagagaagaggatgaacaaagagaggaagcccaggtagaagctggaagggacctagagcaaggggcccaggaagatcaagttgctgaggagaaatgggaagttgtacagaaacaagaggctgagggagtcagagaggatgaggacaaaggacagagggagaaggggtaccatgaagcaagaaaagaccaaggagatggtgaagacagcagaagcccagaagcagcaactgaaggaggagcaggggaggtcagcaaggaacgggagagtggggatggagaggctgagggagaccagagggctggagggtactatttagaagaggacaccctctctgaaggttcaggtgtagcgtccctggaggttgactgtgccaaagagggcaatcctcactcttctgagatggaagaggtagccccacagccacctcagccagaggagatggagcctgaggggcagcccagtccagacggctgtctatgcccctgttctcttggcctgggtggcgtgggcatgcgtctagcttccactctggttcaggtccaacaggtccgctctgtgcctgtggtgccccccaagccacagtttgccaagatgcccagtgcaatgtgtagcaagattcatgtggcacctgcaaatccatgcccgaggcctggccggcttgatgggactcctggagaaagggcttgggggtcccgagcttctcgatcctcttggaggaatgggggtagtctttcctttgatgctgctgtggccctagcccgggaccgccaaaggactgaggctcaaggagttcggcgaacccagacctgtactgagggtggggattactgcctcatccccagaacctccccttgtagcatgatctctgcccattctcctcggccccttagctgcctggagctcccatctgaaggtgcagaagggtctggatcccggagtcgtcttagtctgccccccagagaaccccaggttcctgaccccctgttgtcctctcagcgcaggtcatatgcatttgaaacacaggctaaccctgggaaaggtgaaggactgtgattaggaccacagccctgggcaaaggggaccagcaagttgtcttgaatctccagggttcctgactagctgtctcctctgcagcatgagcagctgtagtgcccaactctataggctttggccctccagcttctctctttgactgtgggaggcactgccttggttggtttacctgaacttgtctccgacacaaagcacttatctcttaggagattcccaagaaagtcaacaagatcttgttcccagggagtgggtcattggccaaagggaacataaggtaggcagaaaacttaaaagagtttgttaaagtgaagactggagaaattcctcccttcctctgagctgtgaatctctcttcatgaaagccaaaggtagagacagggaggacagggccaggttagggccttccacacacaaacacttctagagttgcccattcctgttatgttcttggaccctaagatacctcctgtcccttttaaatccagattaagagaaacgtccaggaagagctctttgaagccctcaatatttgttggagggactggactcctctccagctccccaccctctgcctccagtcaccatgtgcaagagaggtcctgtacagatctctctgggctctcctttctcctttggaataacttgttcctatttcaggaaagggaaatggtgtcactcaggccctgggactgcttctccagccaggctggggccacaggtcccactctagtgaaggtcaatgtctcagaataaaagctgtatttttacaaaaaaaaaaaagt

SEQ ID NO: 307899 - DNA, 2442 bp, Homo sapiens
ggatgggctactggaggagctcctgggagttgggcctcaggtggaggagttctctgtggagccacccctggatgacctgtctctggatgaggcacagtttgtcttggcccccagctgctgttccgtggactccgctggccccaggcctgaagttgaggaggaaaatggggaggaagttttcctgagtgcctatgatgacctaagtccccttctgggacctaaacccccaatctggaagggttcagggagtctggagggagaggcagcaggatgtggaaggcaggctctgggacagggtggggaagagcaggcatgctgggaagttggggaggacaagcaggctgagcctggaggcaggctagacatcagggaagaggcagagggaagtccagagaccaaggtggaggctggaaaggccagtgaggatagaggggaggctgggggaagccaagagacaaaagtcagattgagagaagggagtagggaagagacagaggccaaggaagagaagtccaaaggtcagaagaaggctgacagtatggaggctaaaggtgtggaggaaccaggaggagatgagtatacagatgagaaggaaaaagaaattgagagagaagaggatgaacaaagagaggaagcccaggtagaagctggaagggacctagagcaaggggcccaggaagatcaagttgctgaggagaaatgggaagttgtacagaaacaagaggctgagggagtcagagaggatgaggacaaaggacagagggagaaggggtaccatgaagcaagaaaagaccaaggagatggtgaagacagcagaagcccagaagcagcaactgaaggaggagcaggggaggtcagcaaggaacgggagagtggggatggagaggctgagggagaccagagggctggagggtactatttagaagaggacaccctctctgaaggttcaggtgtagcgtccctggaggttgactgtgccaaagagggcaatcctcactcttctgagatggaagaggtagccccacagccacctcagccagaggagatggagcctgaggggcagcccagtccagacggctgtctatgcccctgttctcttggcctgggtggcgtgggcatgcgtctagcttccactctggttcaggtccaacaggtccgctctgtgcctgtggtgccccccaagccacagtttgccaagatgcccagtgcaatgtgtagcaagattcatgtggcacctgcaaatccatgcccgaggcctggccggcttgatgggactcctggagaaagggcttgggggtcccgagcttctcgatcctcttggaggaatgggggtagtctttcctttgatgctgctgtggccctagcccgggaccgccaaaggactgaggctcaaggagttcggcgaacccagacctgtactgagggtggggattactgcctcatccccagaacctccccttgtagcatgatctctgcccattctcctcggccccttagctgcctggagctcccatctgaaggtgcagaagggtctggatcccggagtcgtcttagtctgccccccagagaaccccaggttcctgaccccctgttgtcctctcagcgcaggtcatatgcatttgaaacacaggctaaccctgggaaaggtgaaggactgtgattaggaccacagccctgggcaaaggggaccagcaagttgtcttgaatctccagggttcctgactagctgtctcctctgcagcatgagcagctgtagtgcccaactctataggctttggccctccagcttctctctttgactgtgggaggcactgccttggttggtttacctgaacttgtctccgacacaaagcacttatctcttaggagattcccaagaaagtcaacaagatcttgttcccagggagtgggtcattggccaaagggaacataaggtaggcagaaaacttaaaagagtttgttaaagtgaagactggagaaattcctcccttcctctgagctgtgaatctctcttcatgaaagccaaaggtagagacagggaggacagggccaggttagggccttccacacacaaacacttctagagttgcccattcctgttatgttcttggaccctaagatacctcctgtcccttttaaatccagattaagagaaacgtccaggaagagctctttgaagccctcaatatttgttggagggactggactcctctccagctccccaccctctgcctccagtcaccatgtgcaagagaggtcctgtacagatctctctgggctctcctttctcctttggaataacttgttcctatttcaggaaagggaaatggtgtcactcaggccctgggactgcttctccagccaggctggggccacaggtcccactctagtgaaggtcaatgtctcagaataaaagctgtatttttacaaaaaaaaaaaagt

SEQ ID NO: 307900 - DNA, 1747 bp, Homo sapiens
tgtggttgcaaagatgctctaacaggaagtgggttaaggagctgcactgcttcctgccccctaaagctgagcggggcgaggagggcgagtgccaggctgggccacgagacacaggacacaatttcttgccagggtcctggtagcttcctcttcaacagccacttccgtgtggccggggccccaggggcaggagctgctgcccgttgcccaggccaccctccacccccaattgggagccctgcccccctggggccgggccaagcccagcagctggctgggatcccatgggggactggtagggcacaggtcttgggggatagaggtgaccgggccagtgccctggggctctggccatgaagtctcggcagaaaggaaagaagaagggcagcgcaaaggagcgggtttttgggtgcgacttgcaggagcacctgcagcactcaggccaggaggtgccccaggtgctaaagagctgtgcagaatttgtggaggagtatggagtggtggatgggatctaccgcctctcaggggtctcctccaacatccagaagcttcggcaggaatttgagtcagagcggaagccagacctgcgtcgggatgtttacctccaagacattcactgcgtctcctccctgtgcaaggcctatttcagagaactgccggatcccctgctcacttaccggctctatgacaagtttgctgaggctgtaggagtgcaattggaacctgagcgcttggtcaagatcctagaggtgcttcgggaactccctgtcccaaactacaggaccctggagttcctcatgaggcacttggtacacatggcctcattcagtgcccagaccaacatgcatgctcgcaacctggccatcgtgtgggctcccaacctgctgaggtctaaggacatagaggcctcaggcttcaatgggacagcggccttcatggaggtgcgggtacaatccatcgtcgtggagttcatcctcacacacgtggaccagctctttgggggtgctgccctctctggtggtgaggtggagagtgggtggcgatcgcttccagggacccgggcatcaggcagccccgaggaccttatgcccaggccactgccttatcacctgcctagcatactgcaggctggcgatggacccccacagatgcggccctaccatactatcatcgagattgcagagcacaagaggaaggggtctttgaaggtcaggaagtggaggtctatcttcaatttaggtcgctctggccatgagactaagcgtaaacttccacggggggctgaggacagggaggataaatccaacaaggggacactgcggccagccaaaagcatggactcactgagtgctgcagctggggccagtgatgagccagaggggctggtggggcccagcagcccccggccaagcccattgctgcctgagagcttggagaacgattctatagaggcagcagagggtgaacaggagcctgaggcagaagcactgggtggcacaaactctgaaccaggcacaccacgagctgggcggtcagccatccgggctgggggcagcagccgtgcagaacgctgtgctggtgtccacatctcagacccctacaatgtcaacctcccgctacacatcacctctatcctcagtgtgcccccgaacatcatctctaacgtttccttggccaggctcacccgtggccttgagtgccctgctctacagcaccggccaagccctgcctctggccctggccctgg

SEQ ID NO: 307901 - DNA, 1812 bp, Homo sapiens
tgtggttgcaaagatgctctaacaggaagtgggttaaggagctgcactgcttcctgccccctaaagctgagcggggcgaggagggcgagtgccaggctgggccacgagacacaggacacaatttcttgccagggtcctggtagcttcctcttcaacagccacttccgtgtggccggggccccaggggcaggagctgctgcccgttgcccaggccaccctccacccccaattgggagccctgcccccctggggccgggccaagcccagcagctggctgggatcccatgggggactggtagggcacaggtcttgggggatagaggtgaccgggccagtgccctggggctctggccatgaagtctcggcagaaaggaaagaagaagggcagcgcaaaggagcgggtttttgggtgcgacttgcaggagcacctgcagcactcaggccaggaggtgccccaggtgctaaagagctgtgcagaatttgtggaggagtatggagtggtggatgggatctaccgcctctcaggggtctcctccaacatccagaagcttcggcaggaatttgagtcagagcggaagccagacctgcgtcgggatgtttacctccaagacattcactgcgtctcctccctgtgcaaggcctatttcagagaactgccggatcccctgctcacttaccggctctatgacaagtttgctgaggctgtaggagtgcaattggaacctgagcgcttggtcaagatcctagaggtgcttcgggaactccctgtcccaaactacaggaccctggagttcctcatgaggcacttggtacacatggcctcattcagtgcccagaccaacatgcatgctcgcaacctggccatcgtgtgggctcccaacctgctgaggtctaaggacatagaggcctcaggcttcaatgggacagcggccttcatggaggtgcgggtacaatccatcgtcgtggagttcatcctcacacacgtggaccagctctttgggggtgctgccctctctggtggtgaggtggagagtgggtggcgatcgcttccagggacccgggcatcaggcagccccgaggaccttatgcccaggccactgccttatcacctgcctagcatactgcaggctggcgatggacccccacagatgcggccctaccatactatcatcgagattgcagagcacaagaggaaggggtctttgaaggtcaggaagtggaggtctatcttcaatttaggtcgctctggccatgagactaagcgtaaacttccacggggggctgaggacagggaggataaatccaacaaggggacactgcggccagccaaaagcatggactcactgagtgctgcagctggggccagtgatgagccagaggggctggtggggcccagcagcccccggccaagcccattgctgcctgagagcttggagaacgattctatagaggcagcagagggtgaacaggagcctgaggcagaagcactgggtggcacaaactctgaaccaggcacaccacgagctgggcggtcagccatccgggctgggggcagcagccgtgcagaacgctgtgctggtgtccacatctcagaccctctgcctccagtcaccatgtgcaagagaggtcctgtacagatctctctgggctctcctttctcctttggaataacttgttcctatttcaggaaagggaaatggtgtcactcaggccctgggactgcttctccagccaggctggggccacaggtcccactctagtgaaggtcaatgtctcagaataaaagctgtatttttacaaaaaaaaaaaagt

SEQ ID NO: 307902 - DNA, 1724 bp, Homo sapiens
acaccccatttgtgtttgtattttttgtagagacagagtttcagcatgttactcagtctgatcttgaactcctgggctcaagcaactcacccgccttggcctctcaaggtgctggcttacaggggtgagccactgcacccagcctgacaaatttcactttaacaaaggcagaactttctaacaaagagctgattgggtagtttggagaggcagtgagctcccaggacctttaggacccactaagcagagatactgtagaggggttggcaggttgaagctgatgatctgtaagaattgttctgacaagtttttattccatgagctttgctcgtcgtggtctccccaaattccatttctcagacccagtgcagtctttgaccacccagatcctctgatttctatgtctctgccccgtctgtgtccccagtgccccaggtgctaaagagctgtgcagaatttgtggaggagtatggagtggtggatgggatctaccgcctctcaggggtctcctccaacatccagaagcttcggcaggaatttgagtcagagcggaagccagacctgcgtcgggatgtttacctccaagacattcactgcgtctcctccctgtgcaaggcctatttcagagaactgccggatcccctgctcacttaccggctctatgacaagtttgctgaggctgtaggagtgcaattggaacctgagcgcttggtcaagatcctagaggtgcttcgggaactccctgtcccaaactacaggaccctggagttcctcatgaggcacttggtacacatggcctcattcagtgcccagaccaacatgcatgctcgcaacctggccatcgtgtgggctcccaacctgctgaggtctaaggacatagaggcctcaggcttcaatgggacagcggccttcatggaggtgcgggtacaatccatcgtcgtggagttcatcctcacacacgtggaccagctctttgggggtgctgccctctctggtggtgaggtggagagtgggtggcgatcgcttccagggacccgggcatcaggcagccccgaggaccttatgcccaggccactgccttatcacctgcctagcatactgcaggctggcgatggacccccacagatgcggccctaccatactatcatcgagattgcagagcacaagaggaaggggtctttgaaggtcaggaagtggaggtctatcttcaatttaggtcgctctggccatgagactaagcgtaaacttccacggggggctgaggacagggaggataaatccaacaaggggacactgcggccagccaaaagcatggactcactgagtgctgcagctggggccagtgatgagccagaggggctggtggggcccagcagcccccggccaagcccattgctgcctgagagcttggagaacgattctatagaggcagcagagggtgaacaggagcctgaggcagaagcactgggtggcacaaactctgaaccaggcacaccacgagctgggcggtcagccatccgggctgggggcagcagccgtgcagaacgctgtgctggtgtccacatctcagacccctacaatgtcaacctcccgctacacatcacctctatcctcagtgtgcccccgaacatcatctctaacgtttccttggccaggctcacccgtggccttgagtgccctgctctacagcaccggccaagccctgcctctggccctggccctgg

SEQ ID NO: 307903 - DNA, 873 bp, Homo sapiens
  misc_feature (790)..(790): n is a, c, g, or t
  misc_feature (829)..(829): n is a, c, g, or t
  misc_feature (859)..(859): n is a, c, g, or t
  misc_feature (873)..(873): n is a, c, g, or t
ggatgggctactggaggagctcctgggagttgggcctcaggtaaggagagccgtgctgggtttgggggtggcatggagtcaagggtggacagggcctcctggtcctgagtcacaatgctgtgcctacaggtggaggagttctctgtggagccacccctggatgacctgtctctggatgaggcacagtttgtcttggcccccagctgctgttccgtggactccgctggccccaggcctgaagttgaggaggaaaatggggaggaagttttcctgagtgcctatgatgacctaagtccccttctgggacctaaacccccaatctggaagggttcagggagtctggagggagaggcagcaggatgtggaaggcaggctctgggacagggtggggaagagcaggcatgctgggaagttggggaggacaagcaggctgagcctggaggcaggctagacatcagggaagaggcagagggaagtccagagaccaaggtggaggctggaaaggccagtgaggatagaggggaggctgggggaagccaagagacaaaagtcagattgagagaagggagtagggaagagacagaggccaaggaagagaagtccaaaggtcagaagaaggctgacagtatggaggctaaaggtgtggaggaaccaggaggagatgagtatacagatgagaaggaaaaagaaattgagagagaagaggatgaacaaagagaggaagcccaggtagaagctggaagggacctagagcaaggggcccaggaagatcaagttgctgaggcagganaatcgcttgagcctgggagacagaggttgcagtgagccnaggtcatgccactgcactccagcctgggtnacaaagactgtctn

SEQ ID NO: 307904 - DNA, 2975 bp, Homo sapiens
agttttaaacgcgcagccgagggccgcgcgcaggagtagggagggcctagggcggcggagccgactcgtcgcggccgaggcgcgcgcggtccgtgccggcgtcagtctgggattggccggcccgcgacttcctccgccccctgccaatcgccggggacgacttccgtgggtttttccggctcccccgcgtcgctaaggagcgacgggctgtcggccagaccccgagttctcggtgcgctcagcggccgccgacgctaggaggccgcgctccgcccccgctaccatgaggccccggaaagccttcctgctcctgctgctcttggggctggtgcagctgctggccgtggcgggtgccgagggcccggacgaggattcttctaacagagaaaatgccattgaggatgaagaggaggaggaggaggaagatgatgatgaggaagaagacgacttggaagttaaggaagaaaatggagtcttggtcctaaatgatgcaaactttgataattttgtggctgacaaagacacagtgctgctggagttttatgctccatggtgtggacattgcaagcagtttgctccggaatatgaaaaaattgccaacatattaaaggataaagatcctcccattcctgttgccaagatcgatgcaacctcagcgtctgtgctggccagcaggtttgatgtgagtggctaccccaccatcaagatccttaagaaggggcaggctgtagactacgagggctccagaacccaggaagaaattgttgccaaggtcagagaagtctcccagcccgactggacgcctccaccagaagtcacgcttgtgttgaccaaagagaactttgatgaagttgtgaatgatgcagatatcattctggtggagttttatgccccatggtgtggacactgcaagaaacttgcccccgagtatgagaaggccgccaaggagctcagcaagcgttctcctccaattcccctggcaaaggtcgacgccaccgcagaaacagacctggccaagaggtttgatgtctctggctatcccaccctgaaaattttccgcaaaggaaggccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccagggctccacccaggactcggccatcaaggacttcgtgctgaagtacgccctgcccctggttggccaccgcaaggtgtcaaacgatgctaagcgctacaccaggcgccccctggtggtcgtctactacagtgtggacttcagctttgattacagagctgcaactcagttttggcggagcaaagtcctagaggtggccaaggacttccctgagtacacctttgccattgcggacgaagaggactatgctggggaggtgaaggacctggggctcagcgagagtggggaggatgtcaatgccgccatcctggacgagagtgggaagaagttcgccatggagccagaggagtttgactctgacaccctccgcgagtttgtcactgctttcaaaaaaggaaaactgaagccagtcatcaaatcccagccagtgcccaagaacaacaagggacccgtcaaggtcgtggtgggaaagacctttgactccattgtgatggaccccaagaaggacgtcctcatcgagttctacgcgccatggtgcgggcactgcaagcagctagagcccgtgtacaacagcctggccaagaagtacaagggccaaaagggcctggtcatcgccaagatggacgccactgccaacgacgtccccagcgaccgctataaggtggagggcttccccaccatctacttcgcccccagtggggacaaaaagaacccagttaaatttgagggtggagacagagatctggagcatttgagcaagtttatagaagaacatgccacaaaactgagcaggaccaaggaagagctttgaaggcctgaggtctgcggaaggtgggaggaggcagacgccctgcgtggcccatggtcggggcgtccacgccgaggccggcaacaaacgacagtatctcggattcctttttttttttttttaattttttatactttggtgtttcacttcatgctctgaatactgaataaccatgaatgactgaatagtttagtccagatttttacagaggatacatctatttttatcattatttggggtttgaaaaatttttttttacaccttctaatttctttatttctcaaagcagataattcttctgtgtgaaaatgttttctttttttaatttaaggtttaaaattccttttccaaatcatgttgattttgctctttgctttttcgttgtctgagaaattgttggcgtagatttggcttctggtatgtgtttctgattgcttcctgttgagcacaaagtgagagctgccactgagcagccctgccaggggtgctgtttcaggctgggcatcgccaggcggcctccctgcaaaccaagggctgggggcaaaggggcatgatccagggtcccccagggtgggctcagctccagggagaggccacccacgtggcagccccacctcttgagagcccccagtgccggagcagaaaggaccctggacccagaggcagatactgcggggtggtagaaaaggtagagtaggctgtggcaatggaataaaacacgattaaaaacgttaagaactgcgttaaaaaaaaaaaa

SEQ ID NO: 307905 - DNA, 799 bp, Homo sapiens
agttttaaacgcgcagccgagggccgcgcgcaggagtagggagggcctagggcggcggagccgactcgtcgcggccgaggcgcgcgcggtccgtgccggcgtcagtctgggattggccggcccgcgacttcctccgccccctgccaatcgccggggacgacttccgtgggtttttccggctcccccgcgtcgctaaggagcgacgggctgtcggccagaccccgagttctcggtgcgctcagcggccgccgacgctaggaggccgcgctccgcccccgctaccatgaggccccggaaagccttcctgctcctgctgctcttggggctggtgcagctgctggccgtggcgggtgccgagggcccggacgaggattcttctaacagagaaaatgccattgaggatgaagaggaggaggaggaggaagatgatgatgaggaagaagacgacttggaagttaaggaagaaaatggagtcttggtcctaaatgatgcaaactttgataattttgtggctgacaaagacacagtgctgctggagttttatgctccatggtgtggacattgcaagcagtttgctccggaatatgaaaaaattgccaacatattaaaggataaagatcctcccattcctgttgccaagatcgatgcaacctcagcgtctgtgctggccagcaggtttgatgtgagtggctaccccaccatcaagatccttaagaaggggcaggctgtagactacgagggctccagaacccaggaagaaattgtgcctaagttcagaccgagatctctagatcaccca

SEQ ID NO: 307906 - DNA, 594 bp, Homo sapiens
agttttaaacgcgcagccgagggccgcgcgcaggagtagggagggcctagggcggcggagccgactcgtcgcggccgaggcgcgcgcggtccgtgccggcgtcagtctgggattggccggcccgcgacttcctccgccccctgccaatcgccggggacgacttccgtgggtttttccggctcccccgcgtcgctaaggagcgacgggctgtcggccagaccccgagttctcggtgcgctcagcggccgccgacgctaggaggccgcgctccgcccccgctaccatgaggccccggaaagccttcctgctcctgctgctcttggggctggtgcagctgctggccgtggcgggtgccgagggcccggacgaggattcttctaacagagaaaatgccattgaggatgaagaggaggaggaggaggaagatgatgatgaggaagaagacgacttggaagttaaggaagaaaacggtttgtttggaccccgatgaactttactttgataaatctgaggatttcaggggcgcaccggggcccgagtttgcctattcaaaggtgtttacatagccaagcggggggtggccgaaaaaggata

SEQ ID NO: 307907 - DNA, 799 bp, Homo sapiens
atgtctttcccagtgggtggaacccccaccccctgtatcaagtgtggaagtgccggtctttcatctatgaccctggggaatccattctttcccctcccctccccccattgtttctccagaagaaaagggaaaaggggaaacttcttgctctcctttaaattttaaatgttttactcacccgataaattttggaatatcctcctcgccgttttggatatcccggcctttttgtgtgggttttttttttccaattttgtgttggttttttttttttgtatttcagcccccggaaaagaaaaggtgagtgccacctcaggaagaaattgttgccaaggtcagagaagtctcccagcccgactggacgcctccaccagaagtcacgcttgtgttgaccaaagagaactttgatgaagttgtgaatgatgcagatatcattctggtggagttttatgccccatggtgtggacactgcaagaaacttgcccccgagtatgagaaactatgacaatggagaaaaacagctttaaagagcttagataatcctctgaattaaaggcatacttactacttctgaacacagaaaacgcctggggattgtactggcaagagaccacctattctaaacctcaggtacaaagtgtccacttgcctccagacaatactgaattgtactttctccttggtacttcccattcgatgaagcagtctctctctgtggtctctgaaccactatttataaaagtgatgactccaggaccacagcccataccacctgaggcaatccctaagttcagagaca

SEQ ID NO: 307908 - DNA, 225 bp, Homo sapiens
aattcaagcttctaacgatgtacggggagtcccccagggtgggctcagctccagggagaggccacccacgtggcagccccacctcttgagagcccccagtgccggagcagaaaggaccctggacccagaggcagatactgcggggtggtagaaaaggtagagtaggctgtggcaatggaataaaacacgattaaaaacgttaagaactgcgttaaaaaaaaaaaa

SEQ ID NO: 307909 - DNA, 556 bp, Homo sapiens
agttttaaacgcgcagccgagggccgcgcgcaggagtagggagggcctagggcggcggagccgactcgtcgcggccgaggcgcgcgcggtccgtgccggcgtcagtctgggattggccggcccgcgacttcctccgccccctgccaatcgccggggacgacttccgtgggtttttccggctcccccgcgtcgctaaggagcgacgggctgtcggccagaccccgagttctcggtgcgctcagcggccgccgacgctaggaggccgcgctccgcccccgctaccatgaggccccggaaagccttcctgctcctgctgctcttggggctggtgcagctgctggccgtggcgggtgccgagggcccggacgaggattttcgtcaggtccaggctaactccaggcgaacgcgcccaggcagtgggaagggagagggagagccactggagagaaggggcgagggcgtgaagcaagtgcgagttctttggaacagcaagcattccttttctgtgattcttctaacagagaagacgacctgtaagtcaagggcgctggcgtcc

SEQ ID NO: 307910 - DNA, 2927 bp, Homo sapiens
agttttaaacgcgcagccgagggccgcgcgcaggagtagggagggcctagggcggcggagccgactcgtcgcggccgaggcgcgcgcggtccgtgccggcgtcagtctgggattggccggcccgcgacttcctccgccccctgccaatcgccggggacgacttccgtgggtttttccggctcccccgcgtcgctaaggagcgacgggctgtcggccagaccccgagttctcggtgcgctcagcggccgccgacgctaggaggccgcgctccgcccccgctaccatgaggccccggaaagccttcctgctcctgctgctcttggggctggtgcagctgctggccgtggcgggtgccgagggcccggacgaggattcttctaacagagaaaatgccattgaggatgaagaggaggaggaggaggaagatgatgatgaggaagaagacgacttggaagttaaggaagaaaatggagtcttggtcctaaatgatgcaaactttgataattttgtggctgacaaagacacagtgctgctggagttttatgctccatggtgtggacattgcaagcagtttgctccggaatatgaaaaaattgccaacatattaaaggataaagatcctcccattcctgttgccaagatcgatgcaacctcagcgtctgtgctggccagcaggtttgatgtgagtggctaccccaccatcaagatccttaagaaggggcaggctgtagactacgagggctccagaacccaggaagaaattgttgccaaggtcagagaagtctcccagcccgactggacgcctccaccagaagtcacgcttgtgttgaccaaagagaactttgatgaagttgtgaatgatgcagatatcattctggtggagttttatgccccatggtgtggacactgcaagaaacttgcccccgagtatgagaaggccgccaaggagctcagcaagcgttctcctccaattcccctggcaaaggtcgacgccaccgcagaaacagacctggccaagaggtttgatgtctctggctatcccaccctgaaaattttccgcaaaggaaggccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccagggctccacccaggactcggccatcaaggacttcgtgctgaagtacgccctgcccctggttggccaccgcaaggtgtcaaacgatgctaagcgctacaccaggcgccccctggtggtcgtctactacagtgtggacttcagctttgattacagagctgcaactcagttttggcggagcaaagtcctagaggtggccaaggacttccctgagtacacctttgccattgcggacgaagaggactatgctggggaggtgaaggacctggggctcagcgagagtggggaggatgtcaatgccgccatcctggacgagagtgggaagaagttcgccatggagccagaggagtttgactctgacaccctccgcgagtttgtcactgctttcaaaaaaggaaaactgaagccagtcatcaaatcccagccagtgcccaagaacaacaagggacccgtcaaggtcgtggtgggaaagacctttgactccattgtgatggaccccaagaaggacgtcctcatcgagttctacgcgccatggtgcgggcactgcaagcagctagagcccgtgtacaacagcctggccaagaagtacaagggccaaaagggcctggtcatcgccaagatggacgccactgccaacgacgtccccagcgaccgctataaggtggagggcttccccaccatctacttcgcccccagtggggacaaaaagaacccagttaaatttgagggtggagacagagatctggagcatttgagcaagtttatagaagaacatgccacaaaactgagcaggaccaaggaagagctttgaaggcctgaggtctgcggaaggtgggaggaggcagacgccctgcgtggcccatggtcggggcgtccacgccgaggccggcaacaaacgacagtatctcggattcctttttttttttttttaattttttatactttggtgtttcacttcatgctctgaatactgaataaccatgaatgactgaatagtttagtccagatttttacagaggatacatctatttttatcattatttggggtttgaaaaatttttttttacaccttctaatttctttatttctcaaagcagataattcttctgtgtgaaaatgttttctttttttaatttaaggtttaaaattccttttccaaatcatgttgattttgctctttgctttttcgttgtctgagaaattgttggcgtagatttggcttctggtatgtgtttctgattgcttcctgttgagcacaaagtgagagctgccactgagcagccctgccaggggtgctgtttcaggctgggcatcgccaggcggcctccctgcaaaccaagggctgggggcaaaggggcatgatccaggccccacctcttgagagcccccagtgccggagcagaaaggaccctggacccagaggcagatactgcggggtggtagaaaaggtagagtaggctgtggcaatggaataaaacacgattaaaaacgttaagaactgcgttaaaaaaaaaaaa

SEQ ID NO: 307911 - DNA, 3059 bp, Homo sapiens
agttttaaacgcgcagccgagggccgcgcgcaggagtagggagggcctagggcggcggagccgactcgtcgcggccgaggcgcgcgcggtccgtgccggcgtcagtctgggattggccggcccgcgacttcctccgccccctgccaatcgccggggacgacttccgtgggtttttccggctcccccgcgtcgctaaggagcgacgggctgtcggccagaccccgagttctcggtgcgctcagcggccgccgacgctaggaggccgcgctccgcccccgctaccatgaggccccggaaagccttcctgctcctgctgctcttggggctggtgcagctgctggccgtggcgggtgccgagggcccggacgaggattcttctaacagagaaaatgccattgaggatgaagaggaggaggaggaggaagatgatgatgaggaagaagacgacttggaagttaaggaagaaaatggagtcttggtcctaaatgatgcaaactttgataattttgtggctgacaaagacacagtgctgctggagttttatgctccatggtgtggacattgcaagcagtttgctccggaatatgaaaaaattgccaacatattaaaggataaagatcctcccattcctgttgccaagatcgatgcaacctcagcgtctgtgctggccagcaggtttgatgtgagtggctaccccaccatcaagatccttaagaaggggcaggctgtagactacgagggctccagaacccaggaagatggagtcttcctctgtctcccaggctggagtgtgcagtggtgcaatcttggctcaccgaacagcctccacctccggggttcagaaattgttgccaaggtcagagaagtctcccagcccgactggacgcctccaccagaagtcacgcttgtgttgaccaaagagaactttgatgaagttgtgaatgatgcagatatcattctggtggagttttatgccccatggtgtggacactgcaagaaacttgcccccgagtatgagaaggccgccaaggagctcagcaagcgttctcctccaattcccctggcaaaggtcgacgccaccgcagaaacagacctggccaagaggtttgatgtctctggctatcccaccctgaaaattttccgcaaaggaaggccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccagggctccacccaggactcggccatcaaggacttcgtgctgaagtacgccctgcccctggttggccaccgcaaggtgtcaaacgatgctaagcgctacaccaggcgccccctggtggtcgtctactacagtgtggacttcagctttgattacagagctgcaactcagttttggcggagcaaagtcctagaggtggccaaggacttccctgagtacacctttgccattgcggacgaagaggactatgctggggaggtgaaggacctggggctcagcgagagtggggaggatgtcaatgccgccatcctggacgagagtgggaagaagttcgccatggagccagaggagtttgactctgacaccctccgcgagtttgtcactgctttcaaaaaaggaaaactgaagccagtcatcaaatcccagccagtgcccaagaacaacaagggacccgtcaaggtcgtggtgggaaagacctttgactccattgtgatggaccccaagaaggacgtcctcatcgagttctacgcgccatggtgcgggcactgcaagcagctagagcccgtgtacaacagcctggccaagaagtacaagggccaaaagggcctggtcatcgccaagatggacgccactgccaacgacgtccccagcgaccgctataaggtggagggcttccccaccatctacttcgcccccagtggggacaaaaagaacccagttaaatttgagggtggagacagagatctggagcatttgagcaagtttatagaagaacatgccacaaaactgagcaggaccaaggaagagctttgaaggcctgaggtctgcggaaggtgggaggaggcagacgccctgcgtggcccatggtcggggcgtccacgccgaggccggcaacaaacgacagtatctcggattcctttttttttttttttaattttttatactttggtgtttcacttcatgctctgaatactgaataaccatgaatgactgaatagtttagtccagatttttacagaggatacatctatttttatcattatttggggtttgaaaaatttttttttacaccttctaatttctttatttctcaaagcagataattcttctgtgtgaaaatgttttctttttttaatttaaggtttaaaattccttttccaaatcatgttgattttgctctttgctttttcgttgtctgagaaattgttggcgtagatttggcttctggtatgtgtttctgattgcttcctgttgagcacaaagtgagagctgccactgagcagccctgccaggggtgctgtttcaggctgggcatcgccaggcggcctccctgcaaaccaagggctgggggcaaaggggcatgatccagggtcccccagggtgggctcagctccagggagaggccacccacgtggcagccccacctcttgagagcccccagtgccggagcagaaaggaccctggacccagaggcagatactgcggggtggtagaaaaggtagagtaggctgtggcaatggaataaaacacgattaaaaacgttaagaactgcgttaaaaaaaaaaaa

SEQ ID NO: 307912 - DNA, 2537 bp, Homo sapiens
atgtctttcccagtgggtggaacccccaccccctgtatcaagtgtggaagtgccggtctttcatctatgaccctggggaatccattctttcccctcccctccccccattgtttctccagaagaaaagggaaaaggggaaacttcttgctctcctttaaattttaaatgttttactcacccgataaattttggaatatcctcctcgccgttttggatatcccggcctttttgtgtgggttttttttttccaattttgtgttggttttttttttttgtatttcagcccccggaaaagaaaaggtgagtgccacctcaggaagaaattgttgccaaggtcagagaagtctcccagcccgactggacgcctccaccagaagtcacgcttgtgttgaccaaagagaactttgatgaagttgtgaatgatgcagatatcattctggtggagttttatgccccatggtgtggacactgcaagaaacttgcccccgagtatgagaaggccgccaaggagctcagcaagcgttctcctccaattcccctggcaaaggtcgacgccaccgcagaaacagacctggccaagaggtttgatgtctctggctatcccaccctgaaaattttccgcaaaggaaggccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccagggctccacccaggactcggccatcaaggacttcgtgctgaagtacgccctgcccctggttggccaccgcaaggtgtcaaacgatgctaagcgctacaccaggcgccccctggtggtcgtctactacagtgtggacttcagctttgattacagagctgcaactcagttttggcggagcaaagtcctagaggtggccaaggacttccctgagtacacctttgccattgcggacgaagaggactatgctggggaggtgaaggacctggggctcagcgagagtggggaggatgtcaatgccgccatcctggacgagagtgggaagaagttcgccatggagccagaggagtttgactctgacaccctccgcgagtttgtcactgctttcaaaaaaggaaaactgaagccagtcatcaaatcccagccagtgcccaagaacaacaagggacccgtcaaggtcgtggtgggaaagacctttgactccattgtgatggaccccaagaaggacgtcctcatcgagttctacgcgccatggtgcgggcactgcaagcagctagagcccgtgtacaacagcctggccaagaagtacaagggccaaaagggcctggtcatcgccaagatggacgccactgccaacgacgtccccagcgaccgctataaggtggagggcttccccaccatctacttcgcccccagtggggacaaaaagaacccagttaaatttgagggtggagacagagatctggagcatttgagcaagtttatagaagaacatgccacaaaactgagcaggaccaaggaagagctttgaaggcctgaggtctgcggaaggtgggaggaggcagacgccctgcgtggcccatggtcggggcgtccacgccgaggccggcaacaaacgacagtatctcggattcctttttttttttttttaattttttatactttggtgtttcacttcatgctctgaatactgaataaccatgaatgactgaatagtttagtccagatttttacagaggatacatctatttttatcattatttggggtttgaaaaatttttttttacaccttctaatttctttatttctcaaagcagataattcttctgtgtgaaaatgttttctttttttaatttaaggtttaaaattccttttccaaatcatgttgattttgctctttgctttttcgttgtctgagaaattgttggcgtagatttggcttctggtatgtgtttctgattgcttcctgttgagcacaaagtgagagctgccactgagcagccctgccaggggtgctgtttcaggctgggcatcgccaggcggcctccctgcaaaccaagggctgggggcaaaggggcatgatccagggtcccccagggtgggctcagctccagggagaggccacccacgtggcagccccacctcttgagagcccccagtgccggagcagaaaggaccctggacccagaggcagatactgcggggtggtagaaaaggtagagtaggctgtggcaatggaataaaacacgattaaaaacgttaagaactgcgttaaaaaaaaaaaa

SEQ ID NO: 307913 - DNA, 2117 bp, Homo sapiens
gaccgaggagactattggagcatttgagcaagtttataggtgtggacactgcaagaaacttgcccccgagtatgagaaggccgccaaggagctcagcaagcgttctcctccaattcccctggcaaaggtcgacgccaccgcagaaacagacctggccaagaggtttgatgtctctggctatcccaccctgaaaattttccgcaaaggaaggccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccagggctccacccaggactcggccatcaaggacttcgtgctgaagtacgccctgcccctggttggccaccgcaaggtgtcaaacgatgctaagcgctacaccaggcgccccctggtggtcgtctactacagtgtggacttcagctttgattacagagctgcaactcagttttggcggagcaaagtcctagaggtggccaaggacttccctgagtacacctttgccattgcggacgaagaggactatgctggggaggtgaaggacctggggctcagcgagagtggggaggatgtcaatgccgccatcctggacgagagtgggaagaagttcgccatggagccagaggagtttgactctgacaccctccgcgagtttgtcactgctttcaaaaaaggaaaactgaagccagtcatcaaatcccagccagtgcccaagaacaacaagggacccgtcaaggtcgtggtgggaaagacctttgactccattgtgatggaccccaagaaggacgtcctcatcgagttctacgcgccatggtgcgggcactgcaagcagctagagcccgtgtacaacagcctggccaagaagtacaagggccaaaagggcctggtcatcgccaagatggacgccactgccaacgacgtccccagcgaccgctataaggtggagggcttccccaccatctacttcgcccccagtggggacaaaaagaacccagttaaatttgagggtggagacagagatctggagcatttgagcaagtttatagaagaacatgccacaaaactgagcaggaccaaggaagagctttgaaggcctgaggtctgcggaaggtgggaggaggcagacgccctgcgtggcccatggtcggggcgtccacgccgaggccggcaacaaacgacagtatctcggattcctttttttttttttttaattttttatactttggtgtttcacttcatgctctgaatactgaataaccatgaatgactgaatagtttagtccagatttttacagaggatacatctatttttatcattatttggggtttgaaaaatttttttttacaccttctaatttctttatttctcaaagcagataattcttctgtgtgaaaatgttttctttttttaatttaaggtttaaaattccttttccaaatcatgttgattttgctctttgctttttcgttgtctgagaaattgttggcgtagatttggcttctggtatgtgtttctgattgcttcctgttgagcacaaagtgagagctgccactgagcagccctgccaggggtgctgtttcaggctgggcatcgccaggcggcctccctgcaaaccaagggctgggggcaaaggggcatgatccagggtcccccagggtgggctcagctccagggagaggccacccacgtggcagccccacctcttgagagcccccagtgccggagcagaaaggaccctggacccagaggcagatactgcggggtggtagaaaaggtagagtaggctgtggcaatggaataaaacacgattaaaaacgttaagaactgcgttaaaaaaaaaaaa

SEQ ID NO: 307914 - DNA, 2651 bp, Homo sapiens
agttttaaacgcgcagccgagggccgcgcgcaggagtagggagggcctagggcggcggagccgactcgtcgcggccgaggcgcgcgcggtccgtgccggcgtcagtctgggattggccggcccgcgacttcctccgccccctgccaatcgccggggacgacttccgtgggtttttccggctcccccgcgtcgctaaggagcgacgggctgtcggccagaccccgagttctcggtgcgctcagcggccgccgacgctaggaggccgcgctccgcccccgctaccatgaggccccggaaagccttcctgctcctgctgctcttggggctggtgcagctgctggccgtggcgggtgccgagggcccggacgaggattcttctaacagagaaaatgccattgaggatgaagaggaggaggaggaggaagatgatgatgaggaagaagacgacttggaagttaaggaagaaaatggagtcttggtcctaaatgatgcaaactttgataattttgtggctgacaaagacacagtgctgctggagttttatgctccatggtgtggacattgcaagcagtttgctccggaatatgaaaaaattgccaacatattaaaggataaagatcctcccattcctgttgccaagatcgatgcaacctcagcgtctgtgctggccaccgcagaaacagacctggccaagaggtttgatgtctctggctatcccaccctgaaaattttccgcaaaggaaggccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccagggctccacccaggactcggccatcaaggacttcgtgctgaagtacgccctgcccctggttggccaccgcaaggtgtcaaacgatgctaagcgctacaccaggcgccccctggtggtcgtctactacagtgtggacttcagctttgattacagagctgcaactcagttttggcggagcaaagtcctagaggtggccaaggacttccctgagtacacctttgccattgcggacgaagaggactatgctggggaggtgaaggacctggggctcagcgagagtggggaggatgtcaatgccgccatcctggacgagagtgggaagaagttcgccatggagccagaggagtttgactctgacaccctccgcgagtttgtcactgctttcaaaaaaggaaaactgaagccagtcatcaaatcccagccagtgcccaagaacaacaagggacccgtcaaggtcgtggtgggaaagacctttgactccattgtgatggaccccaagaaggacgtcctcatcgagttctacgcgccatggtgcgggcactgcaagcagctagagcccgtgtacaacagcctggccaagaagtacaagggccaaaagggcctggtcatcgccaagatggacgccactgccaacgacgtccccagcgaccgctataaggtggagggcttccccaccatctacttcgcccccagtggggacaaaaagaacccagttaaatttgagggtggagacagagatctggagcatttgagcaagtttatagaagaacatgccacaaaactgagcaggaccaaggaagagctttgaaggcctgaggtctgcggaaggtgggaggaggcagacgccctgcgtggcccatggtcggggcgtccacgccgaggccggcaacaaacgacagtatctcggattcctttttttttttttttaattttttatactttggtgtttcacttcatgctctgaatactgaataaccatgaatgactgaatagtttagtccagatttttacagaggatacatctatttttatcattatttggggtttgaaaaatttttttttacaccttctaatttctttatttctcaaagcagataattcttctgtgtgaaaatgttttctttttttaatttaaggtttaaaattccttttccaaatcatgttgattttgctctttgctttttcgttgtctgagaaattgttggcgtagatttggcttctggtatgtgtttctgattgcttcctgttgagcacaaagtgagagctgccactgagcagccctgccaggggtgctgtttcaggctgggcatcgccaggcggcctccctgcaaaccaagggctgggggcaaaggggcatgatccagggtcccccagggtgggctcagctccagggagaggccacccacgtggcagccccacctcttgagagcccccagtgccggagcagaaaggaccctggacccagaggcagatactgcggggtggtagaaaaggtagagtaggctgtggcaatggaataaaacacgattaaaaacgttaagaactgcgttaaaaaaaaaaaa

SEQ ID NO: 307915 - DNA, 2105 bp, Homo sapiens
agttttaaacgcgcagccgagggccgcgcgcaggagtagggagggcctagggcggcggagccgactcgtcgcggccgaggcgcgcgcggtccgtgccggcgtcagtctgggattggccggcccgcgacttcctccgccccctgccaatcgccggggacgacttccgtgggtttttccggctcccccgcgtcgctaaggagcgacgggctgtcggccagaccccgagttctcggtgcgctcagcggccgccgacgctaggaggccgcgctccgcccccgctaccatgaggccccggaaagccttcctgctcctgctgctcttggggctggtgcagctgctggccgtggcgggtgccgagggcccggacgaggattcttctaacagagaaaatgccattgaggatgaagaggaggaggaggaggaagatgatgatgaggaagaagacgacttggaagttaaggaagaaaatggagtcttggtcctaaatgatgcaaactttgataattttgtggctgacaaagacacagtgctgctggagttttatgctccatggtgtggacattgcaagcagtttgctccggaatatgaaaaaattgccaacatattaaaggataaagatcctcccattcctgttgccaagatcgatgcaacctcagcgtctgtgctggccagcaggtttgatgtgagtggctaccccaccatcaagatccttaagaaggggcaggctgtagactacgagggctccagaacccaggaagaaattgttgccaaggtcagagaagtctcccagcccgactggacgcctccaccagaagtcacgcttgtgttgaccaaagagaactttgatgaagttgtgaatgatgcagatatcattctggtggagttttatgccccatggtgtggacactgcaagaaacttgcccccgagtatgagaaggccgccaaggagctcagcaagcgttctcctccaattcccctggcaaaggtcgacgccaccgcagaaacagacctggccaagaggtttgatgtctctggctatcccaccctgaaaattttccgcaaaggaaggccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccagggctccacccaggactcggccatcaaggacttcgtgctgaagtacgccctgcccctggttggccaccgcaaggtgtcaaacgatgctaagcgctacaccaggcgccccctggtggtcgtctactacagtgtggacttcagctttgattacagagctgcaactcagttttggcggagcaaagtcctagaggtggccaaggacttccctgagtacacctttgccattgcggacgaagaggactatgctggggaggtgaaggacctggggctcagcgagagtggggaggatgtcaatgccgccatcctggacgagagtgggaagaagttcgccatggagccagaggagtttgactctgacaccctccgcgagtttgtcactgctttcaaaaaaggaaaactgaagccagtcatcaaatcccagccagtgcccaagaacaacaagggacccgtcaaggtcgtggtgggaaagacctttgactccattgtgatggaccccaagaaggacgtcctcatcgagttctacgcgccatggtgcgggcactgcaagcagctagagcccgtgtacaacagcctggccaagaagtacaagggccaaaagggcctggtcatcgccaagatggacgccactgccaacgacgttcccccagacgggaaaaaaaaaccccggggggggcgggggttttttttttttt

SEQ ID NO: 307916 - DNA, 2098 bp, Homo sapiens
agttttaaacgcgcagccgagggccgcgcgcaggagtagggagggcctagggcggcggagccgactcgtcgcggccgaggcgcgcgcggtccgtgccggcgtcagtctgggattggccggcccgcgacttcctccgccccctgccaatcgccggggacgacttccgtgggtttttccggctcccccgcgtcgctaaggagcgacgggctgtcggccagaccccgagttctcggtgcgctcagcggccgccgacgctaggaggccgcgctccgcccccgctaccatgaggccccggaaagccttcctgctcctgctgctcttggggctggtgcagctgctggccgtggcgggtgccgagggcccggacgaggattcttctaacagagaaaatgccattgaggatgaagaggaggaggaggaggaagatgatgatgaggaagaagacgacttggaagttaaggaagaaaatggagtcttggtcctaaatgatgcaaactttgataattttgtggctgacaaagacacagtgctgctggagttttatgctccatggtgtggacattgcaagcagtttgctccggaatatgaaaaaattgccaacatattaaaggataaagatcctcccattcctgttgccaagatcgatgcaacctcagcgtctgtgctggccagcaggtttgatgtgagtggctaccccaccatcaagatccttaagaaggggcaggctgtagactacgagggctccagaacccaggaagaaattgttgccaaggtcagagaagtctcccagcccgactggacgcctccaccagaagtcacgcttgtgttgaccaaagagaactttgatgaagttgtgaatgatgcagatatcattctggtggagttttatgccccatggtgtggacactgcaagaaacttgcccccgagtatgagaaggccgccaaggagctcagcaagcgttctcctccaattcccctggcaaaggtcgacgccaccgcagaaacagacctggccaagaggtttgatgtctctggctatcccaccctgaaaattttccgcaaaggaaggccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccagggctccacccaggactcggccatcaaggacttcgtgctgaagtacgccctgcccctggttggccaccgcaaggtgtcaaacgatgctaagcgctacaccaggcgccccctggtggtcgtctactacagtgtggacttcagctttgattacagagctgcaactcagttttggcggagcaaagtcctagaggtggccaaggacttccctgagtacacctttgccattgcggacgaagaggactatgctggggaggtgaaggacctggggctcagcgagagtggggaggatgtcaatgccgccatcctggacgagagtgggaagaagttcgccatggagccagaggagtttgactctgacaccctccgcgagtttgtcactgctttcaaaaaaggaaaactgaagccagtcatcaaatcccagccagtgcccaagaacaacaagggacccgtcaaggtcgtggtgggaaagacctttgactccattgtgatggaccccaagaaggacgtcctcatcgagttctacgcgccatggtgcgggcactgcaagcagctagagcccgtgtacaacagcctggccaagaagtacaagggccaaaagggcctggtcatcgccaagatggacgccactgccaacgaagtttccccaaggccggggtccaccccccgggggcgcccccctcttttt

SEQ ID NO: 307917 - DNA, 913 bp, Homo sapiens
tggcacactctagagtatccccactcctaccccacggttgctggtgacagcaaaaagaacccagttaaatttgagggtggagacagagatctggagcatttgagcaagtttatagaagaacatgccacaaaactgagcaggaccaaggaagagctttgaaggcctgaggtctgcggaaggtgggaggaggcagacgccctgcgtggcccatggtcggggcgtccacgccgaggccggcaacaaacgacagtatctcggattcctttttttttttttttaattttttatactttggtgtttcacttcatgctctgaatactgaataaccatgaatgactgaatagtttagtccagatttttacagaggatacatctatttttatcattatttggggtttgaaaaatttttttttacaccttctaatttctttatttctcaaagcagataattcttctgtgtgaaaatgttttctttttttaatttaaggtttaaaattccttttccaaatcatgttgattttgctctttgctttttcgttgtctgagaaattgttggcgtagatttggcttctggtatgtgtttctgattgcttcctgttgagcacaaagtgagagctgccactgagcagccctgccaggggtgctgtttcaggctgggcatcgccaggcggcctccctgcaaaccaagggctgggggcaaaggggcatgatccagggtcccccagggtgggctcagctccagggagaggccacccacgtggcagccccacctcttgagagcccccagtgccggagcagaaaggaccctggacccagaggcagatactgcggggtggtagaaaaggtagagtaggctgtggcaatggaataaaacacgattaaaaacgttaagaactgcgttaaaaaaaaaaaa

SEQ ID NO: 307918 - DNA, 1414 bp, Homo sapiens
agttttaaacgcgcagccgagggccgcgcgcaggagtagggagggcctagggcggcggagccgactcgtcgcggccgaggcgcgcgcggtccgtgccggcgtcagtctgggattggccggcccgcgacttcctccgccccctgccaatcgccggggacgacttccgtgggtttttccggctcccccgcgtcgctaaggagcgacgggctgtcggccagaccccgagttctcggtgcgctcagcggccgccgacgctaggaggccgcgctccgcccccgctaccatgaggccccggaaagccttcctgctcctgctgctcttggggctggtgcagctgctggccgtggcgggtgccgagggcccggacgaggattcttctaacagagaaaatgccattgaggatgaagaggaggaggaggaggaagatgatgatgaggaagaagacgacttggaagttaaggaagaaaatggagtcttggtcctaaatgatgcaaactttgataattttgtggctgacaaagacacagtgctgctggagttttatgctccatggtgtggacattgcaagcagtttgctccggaatatgaaaaaattgccaacatattaaaggataaagatcctcccattcctgttgccaagatcgatgcaacctcagcgtctgtgctggccagcaggtttgatgtgagtggctaccccaccatcaagatccttaagaaggggcaggctgtagactacgagggctccagaacccaggaagaaattgttgccaaggtcagagaagtctcccagcccgactggacgcctccaccagaagtcacgcttgtgttgaccaaagagaactttgatgaagttgtgaatgatgcagatatcattctggtggagttttatgccccatggtgtggacactgcaagaaacttgcccccgagtatgagaaggccgccaaggagctcagcaagcgttctcctccaattcccctggcaaaggtcgacgccaccgcagaaacagacctggccaagaggtttgatgtctctggctatcccaccctgaaaattttccgcaaaggaaggccttatgactacaacggcccacgagaaaaatatgaatcgttgattacgcgggttcaggaggtacccaaactgaaggtatgtgcactgcgcgtgaccagccgggccgcagcgcatcctcagggcagggggcaagatcctcactttcgaccagctggccctggactcccctaagggctgtggcactgtcctgctctccggtcctcgcaagggccgagaggtgtaccggcatttcggcaagcccaggaacccgcacagcacacaaacctacgtcgtccaaggccgaagtcgagcgtgcagaggcgagggcagcggggtaaaaaaatacccggatctatctttttaaag

SEQ ID NO: 307919 - DNA, 614 bp, Homo sapiens
aattcaagcttctaacgatgtacggggacatgaatgactgaatagtttagtccagatttttacagaggatacatctatttttatcattatttggggtttgaaaaatttttttttacaccttctaatttctttatttctcaaagcagataattcttctgtgtgaaaatgttttctttttttaatttaaggtttaaaattccttttccaaatcatgttgattttgctctttgctttttcgttgtctgagaaattgttggcgtagatttggcttctggtatgtgtttctgattgcttcctgttgagcacaaagtgagagctgccactgagcagccctgccaggggtgctgtttcaggctgggcatcgccaggcggcctccctgcaaaccaagggctgggggcaaaggggcatgatccagggtcccccagggtgggctcagctccagggagaggccacccacgtggcagccccacctcttgagagcccccagtgccggagcagaaaggaccctggacccagaggcagatactgcggggtggtagaaaaggtagagtaggctgtggcaatggaataaaacacgattaaaaacgttaagaactgcgttaaaaaaaaaaaa

SEQ ID NO: 307920 - DNA, 1351 bp, Homo sapiens
agttttaaacgcgcagccgagggccgcgcgcaggagtagggagggcctagggcggcggagccgactcgtcgcggccgaggcgcgcgcggtccgtgccggcgtcagtctgggattggccggcccgcgacttcctccgccccctgccaatcgccggggacgacttccgtgggtttttccggctcccccgcgtcgctaaggagcgacgggctgtcggccagaccccgagttctcggtgcgctcagcggccgccgacgctaggaggccgcgctccgcccccgctaccatgaggccccggaaagccttcctgctcctgctgctcttggggctggtgcagctgctggccgtggcgggtgccgagggcccggacgaggattcttctaacagagaaaatgccattgaggatgaagaggaggaggaggaggaagatgatgatgaggaagaagacgacttggaagttaaggaagaaaatggagtcttggtcctaaatgatgcaaactttgataattttgtggctgacaaagacacagtgctgctggagttttatgctccatggtgtggacattgcaagcagtttgctccggaatatgaaaaaattgccaacatattaaaggataaagatcctcccattcctgttgccaagatcgatgcaacctcagcgtctgtgctggccagcaggtttgatgtgagtggctaccccaccatcaagatccttaagaaggggcaggctgtagactacgagggctccagaacccaggaagatggagtcttcctctgtctcccaggctggagtgtgcagtggtgcaatcttggctcaccgaacagcctccacctccggggttcagaaattgttgccaaggtcagagaagtctcccagcccgactggacgcctccaccagaagtcacgcttgtgttgaccaaagagaactttgatgaagttgtgaatgatgcagatatcattctggtggagttttatgccccatggtgtggacactgcaagaaacttgcccccgagtatgagaaggccgccaaggagctcagcaagcgttctcctccaattcccctggcaaaggtcgacgccaccgcagaaacagacctggccaagaggtttgatgtctctggctatcccaccctgaaaattttccgcaaaggaaggccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagatttccaatttaacccacttttcgcccgtggccgtcttg

SEQ ID NO: 307921 - DNA, 875 bp, Homo sapiens
agttttaaacgcgcagccgagggccgcgcgcaggagtagggagggcctagggcggcggagccgactcgtcgcggccgaggcgcgcgcggtccgtgccggcgtcagtctgggattggccggcccgcgacttcctccgccccctgccaatcgccggggacgacttccgtgggtttttccggctcccccgcgtcgctaaggagcgacgggctgtcggccagaccccgagttctcggtgcgctcagcggccgccgacgctaggaggccgcgctccgcccccgctaccatgaggccccggaaagccttcctgctcctgctgctcttggggctggtgcagctgctggccgtggcgggtgccgagggcccggacgaggattcttctaacagagaaaatgccattgaggatgaagaggaggaggaggaggaagatgatgatgaggaagaagacgacttggaagttaaggaagaaaatggagtcttggtcctaaatgatgcaaactttgataattttgtggctgacaaagacacagtgctgctggagttttatgctccatggtgtggacattgcaagcagtttgctccggaatatgaaaaaattgccaacatattaaaggataaagatcctcccattcctgttgccaagatcgatgcaacctcagcgtctgtgctggccagcaggtttgatgtgagtggctaccccaccatcaagatccttaagaaggggcaggctgtagactacgagggctccagaacccaggaagacggagttttgcttctgtggcccaggctgcagtacgatggcgcaatctcagctcaccgcaacctccacctcccggattcaagtgattctcctgcctcagcctccagagtagctgtga

SEQ ID NO: 307922 - DNA, 3095 bp, Homo sapiens
agttttaaacgcgcagccgagggccgcgcgcaggagtagggagggcctagggcggcggagccgactcgtcgcggccgaggcgcgcgcggtccgtgccggcgtcagtctgggattggccggcccgcgacttcctccgccccctgccaatcgccggggacgacttccgtgggtttttccggctcccccgcgtcgctaaggagcgacgggctgtcggccagaccccgagttctcggtgcgctcagcggccgccgacgctaggaggccgcgctccgcccccgctaccatgaggccccggaaagccttcctgctcctgctgctcttggggctggtgcagctgctggccgtggcgggtgccgagggcccggacgaggattcttctaacagagaaaatgccattgaggatgaagaggaggaggaggaggaagatgatgatgaggaagaagacgacttggaagttaaggaagaaaatggagtcttggtcctaaatgatgcaaactttgataattttgtggctgacaaagacacagtgctgctggagttttatgctccatggtgtggacattgcaagcagtttgctccggaatatgaaaaaattgccaacatattaaaggataaagatcctcccattcctgttgccaagatcgatgcaacctcagcgtctgtgctggccagcaggtttgatgtgagtggctaccccaccatcaagatccttaagaaggggcaggctgtagactacgagggctccagaacccaggaagaaattgttgccaaggtcagagaagtctcccagcccgactggacgcctccaccagaagtcacgcttgtgttgaccaaagagaactttgatgaagttgtgaatgatgcagatatcattctggtggagttttatgccccatggtgtggacactgcaagaaacttgcccccgagtatgagaaggccgccaaggagctcagcaagcgttctcctccaattcccctggcaaaggtcgacgccaccgcagaaacagacctggccaagaggtttgatgtctctggctatcccaccctgaaaattttccgcaaaggaaggccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccagggctccacccaggactcggccatcaaggacttcgtgctgaagtacgccctgcccctggttggccaccgcaaggtgtcaaacgatgctaagcgctacaccaggcgccccctggtggtcgtctactacagtgtggacttcagctttgattacagagctgcaactcagttttggcggagcaaagtcctagaggtggccaaggacttccctgagtacacctttgccattgcggacgaagaggactatgctggggaggtgaaggacctggggctcagcgagagtggggaggatgtcaatgccgccatcctggacgagagtgggaagaagttcgccatggagccagaggagtttgactctgacaccctccgcgagtttgtcactgctttcaaaaaaggaaaactgaagccagtcatcaaatcccagccagtgcccaagaacaacaagggacccgtcaaggtcgtggtgggaaagacctttgactccattgtgatggaccccaagaaggacgtcctcatcgagttctacgcgccatggtgcgggcactgcaagcagctagagcccgtgtacaacagcctggccaagaagtacaagggccaaaagggcctggtcatcgccaagatggacgccactgccaacgacgtccccagcgaccgctataaggtggagggcttccccaccatctacttcgcccccagtggggacaaaaagaacccagttaaatttgagggtggagacagagatctggagcatttgagcaagtttatagaagaacatgccacaaaactgagcaggaccaaggaagagctttgaaggcctgaggtctgcggaaggtgggaggaggcagacgccctgcgtggcccatggtcggggcgtccacgccgaggccggcaacaaacgacagtatctcggattcctttttttttttttttaattttttatactttggtgtttcacttcatgctctgaatactgaataaccatgaatgactgaatagtttagtccagatttttacagaggatacatctatttttatcattatttggggtttgaaaaatttttttttacaccttctaatttctttatttctcaaagcagataattcttctgtgtgaaaatgttttctttttttaatttaaggtttaaaattccttttccaaatcatgttgattaaaaaaaaaaaaaaaaaaaaaaaaaaaaaaaaaaaaagaagggctgggaccaaccgggtgagatccacaagtctctggatgtggctgaaggcaaatacacaattgaagtactttctgttttgaagtgctttcccttttgaatctggtttgaaacatgcagcttctgtctctagcccaaggaaagaccaaaacatagggaaataaaagcatttatctttgtcttggaagtaattgttgaagttgtgcagttgatcagtgcacagttagctgcaatgtttatagaaattgattgttaaaccaaatttacactggcatgtgtggtgtagtttctaaaaggcacttcacatttgaaatttttcttaccttagaaagtttctagtgatctaaatgtctagttttgtattcttttgtgtgtgttcactgtttctcagtattaccacttgaataattctctgtacaggggggtttgtgctatacactgggatgtctaattgcagcaataaagcctttcttt

SEQ ID NO: 307923 - DNA, 767 bp, Homo sapiens
agttttaaacgcgcagccgagggccgcgcgcaggagtagggagggcctagggcggcggagccgactcgtcgcggccgaggcgcgcgcggtccgtgccggcgtcagtctgggattggccggcccgcgacttcctccgccccctgccaatcgccggggacgacttccgtgggtttttccggctcccccgcgtcgctaaggagcgacgggctgtcggccagaccccgagttctcggtgcgctcagcggccgccgacgctaggaggccgcgctccgcccccgctaccatgaggccccggaaagccttcctgctcctgctgctcttggggctggtgcagctgctggccgtggcgggtgccgagggcccggacgaggattttcgtcaggtccaggctaactccaggcgaacgcgcccaggcagtgggaagggagagggagagccactggagagaaggggcgagggcgtgaagcaagtgcgagttctttggaacagcaagcattccttttctgtgattcttctaacagagcccgtctctttccccgccatcccatctccccacctctccctcctcccaccctctctcccctctctcctctcccctccctccaccccctactcccccatctctcctaccttcctatccgccctcccacacctgttctcactccactaccctcctcccccccccctcacccccatcctcacccctctctccccacgccctctccccctcatccatccccccccgctcctcctcctttcttcctcct

SEQ ID NO: 307924 - DNA, 3196 bp, Homo sapiens
  misc_feature (2598)..(2598): n is a, c, g, or t
agttttaaacgcgcagccgagggccgcgcgcaggagtagggagggcctagggcggcggagccgactcgtcgcggccgaggcgcgcgcggtccgtgccggcgtcagtctgggattggccggcccgcgacttcctccgccccctgccaatcgccggggacgacttccgtgggtttttccggctcccccgcgtcgctaaggagcgacgggctgtcggccagaccccgagttctcggtgcgctcagcggccgccgacgctaggaggccgcgctccgcccccgctaccatgaggccccggaaagccttcctgctcctgctgctcttggggctggtgcagctgctggccgtggcgggtgccgagggcccggacgaggattcttctaacagagaaaatgccattgaggatgaagaggaggaggaggaggaagatgatgatgaggaagaagacgacttggaagttaaggaagaaaatggagtcttggtcctaaatgatgcaaactttgataattttgtggctgacaaagacacagtgctgctggagttttatgctccatggtgtggacattgcaagcagtttgctccggaatatgaaaaaattgccaacatattaaaggataaagatcctcccattcctgttgccaagatcgatgcaacctcagcgtctgtgctggccagcaggtttgatgtgagtggctaccccaccatcaagatccttaagaaggggcaggctgtagactacgagggctccagaacccaggaagaaattgttgccaaggtcagagaagtctcccagcccgactggacgcctccaccagaagtcacgcttgtgttgaccaaagagaactttgatgaagttgtgaatgatgcagatatcattctggtggagttttatgccccatggtgtggacactgcaagaaacttgcccccgagtatgagaaggccgccaaggagctcagcaagcgttctcctccaattcccctggcaaaggtcgacgccaccgcagaaacagacctggccaagaggtttgatgtctctggctatcccaccctgaaaattttccgcaaaggaaggccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccagggctccacccaggactcggccatcaaggacttcgtgctgaagtacgccctgcccctggttggccaccgcaaggtgtcaaacgatgctaagcgctacaccaggcgccccctggtggtcgtctactacagtgtggacttcagctttgattacagagctgcaactcagttttggcggagcaaagtcctagaggtggccaaggacttccctgagtacacctttgccattgcggacgaagaggactatgctggggaggtgaaggacctggggctcagcgagagtggggaggatgtcaatgccgccatcctggacgagagtgggaagaagttcgccatggagccagaggagtttgactctgacaccctccgcgagtttgtcactgctttcaaaaaaggaaaactgaagccagtcatcaaatcccagccagtgcccaagaacaacaagggacccgtcaaggtcgtggtgggaaagacctttgactccattgtgatggaccccaagaaggacgtcctcatcgagttctacgcgccatggtgcgggcactgcaagcagctagagcccgtgtacaacagcctggccaagaagtacaagggccaaaagggcctggtcatcgccaagatggacgccactgccaacgacgtccccagcgaccgctataaggtggagggcttccccaccatctacttcgcccccagtggggacaaaaagaacccagttaaatttgagggtggagacagagatctggagcatttgagcaagtttatagaagaacatgccacaaaactgagcaggaccaaggaagagctttgaaggcctgaggtctgcggaaggtgggaggaggcagacgccctgcgtggcccatggtcggggcgtccacgccgaggccggcaacaaacgacagtatctcggattcctttttttttttttttaattttttatactttggtgtttcacttcatgctctgaatactgaataaccatgaatgactgaatagtttagtccagatttttacagaggatacatctatttttatcattatttggggtttgaaaaatttttttttacaccttctaatttctttatttctcaaagcagataattcttctgtgtgaaaatgttttctttttttaatttaaggtttaaaattccttttccaaatcatgttgattaaaaaaaaaaaacaaanaaaaaaaaaaaaaaaaaaaaaaaaaaaaaaaaaaaaaaaaaaaaaaaaaaaaaaaaaaaaaaaaaaaaaaaacaaaaaaagaaaaaaaaaaaaaaaaaaaaaaaaaaaaaaaaagaagaagggggggcggggcgcagcatacattcccggcgcggggggggcacaaagcatgccagcacacctcttcagatgaggaaggagggggcacaaaagggggggattaaatagagacgggcggatctgagggggcatagataaaaacaaaagcaaggttgacggagaaaaggacaacacacaagtgtaccggcgctcgtagacaactatgaagagcgaaaacaaacacaacaacatcatagatggaggcgggggaccgacaacatacataagaagtgacaaccaacccaaccaccagaaaagacccaagccaacgcaagagagagagaacataaaaaacaacataaggagtcgttagagatggagataataccaaccaagtagcaccaacgcgcacgagagaccaaaaaacaccgcaacacaacaagatcacaacaaaaacacacaaacacacgcgagcgcgcacaacaacaaagggaacaaa

SEQ ID NO: 307925 - DNA, 2936 bp, Homo sapiens
agttttaaacgcgcagccgagggccgcgcgcaggagtagggagggcctagggcggcggagccgactcgtcgcggccgaggcgcgcgcggtccgtgccggcgtcagtctgggattggccggcccgcgacttcctccgccccctgccaatcgccggggacgacttccgtgggtttttccggctcccccgcgtcgctaaggagcgacgggctgtcggccagaccccgagttctcggtgcgctcagcggccgccgacgctaggaggccgcgctccgcccccgctaccatgaggccccggaaagccttcctgctcctgctgctcttggggctggtgcagctgctggccgtggcgggtgccgagggcccggacgaggattcttctaacagagaaaatgccattgaggatgaagaggaggaggaggaggaagatgatgatgaggaagaagacgacttggaagttaaggaagaaaatggagtcttggtcctaaatgatgcaaactttgataattttgtggctgacaaagacacagtgctgctggagttttatgctccatggtgtggacattgcaagcagtttgctccggaatatgaaaaaattgccaacatattaaaggataaagatcctcccattcctgttgccaagatcgatgcaacctcagcgtctgtgctggccagcaggtttgatgtgagtggctaccccaccatcaagatccttaagaaggggcaggctgtagactacgagggctccagaacccaggaagaaattgttgccaaggtcagagaagtctcccagcccgactggacgcctccaccagaagtcacgcttgtgttgaccaaagagaactttgatgaagttgtgaatgatgcagatatcattctggtggagttttatgccccatgggccgccaaggagctcagcaagcgttctcctccaattcccctggcaaaggtcgacgccaccgcagaaacagacctggccaagaggtttgatgtctctggctatcccaccctgaaaattttccgcaaaggaaggccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccagggctccacccaggactcggccatcaaggacttcgtgctgaagtacgccctgcccctggttggccaccgcaaggtgtcaaacgatgctaagcgctacaccaggcgccccctggtggtcgtctactacagtgtggacttcagctttgattacagagctgcaactcagttttggcggagcaaagtcctagaggtggccaaggacttccctgagtacacctttgccattgcggacgaagaggactatgctggggaggtgaaggacctggggctcagcgagagtggggaggatgtcaatgccgccatcctggacgagagtgggaagaagttcgccatggagccagaggagtttgactctgacaccctccgcgagtttgtcactgctttcaaaaaaggaaaactgaagccagtcatcaaatcccagccagtgcccaagaacaacaagggacccgtcaaggtcgtggtgggaaagacctttgactccattgtgatggaccccaagaaggacgtcctcatcgagttctacgcgccatggtgcgggcactgcaagcagctagagcccgtgtacaacagcctggccaagaagtacaagggccaaaagggcctggtcatcgccaagatggacgccactgccaacgacgtccccagcgaccgctataaggtggagggcttccccaccatctacttcgcccccagtggggacaaaaagaacccagttaaatttgagggtggagacagagatctggagcatttgagcaagtttatagaagaacatgccacaaaactgagcaggaccaaggaagagctttgaaggcctgaggtctgcggaaggtgggaggaggcagacgccctgcgtggcccatggtcggggcgtccacgccgaggccggcaacaaacgacagtatctcggattcctttttttttttttttaattttttatactttggtgtttcacttcatgctctgaatactgaataaccatgaatgactgaatagtttagtccagatttttacagaggatacatctatttttatcattatttggggtttgaaaaatttttttttacaccttctaatttctttatttctcaaagcagataattcttctgtgtgaaaatgttttctttttttaatttaaggtttaaaattccttttccaaatcatgttgattttgctctttgctttttcgttgtctgagaaattgttggcgtagatttggcttctggtatgtgtttctgattgcttcctgttgagcacaaagtgagagctgccactgagcagccctgccaggggtgctgtttcaggctgggcatcgccaggcggcctccctgcaaaccaagggctgggggcaaaggggcatgatccagggtcccccagggtgggctcagctccagggagaggccacccacgtggcagccccacctcttgagagcccccagtgccggagcagaaaggaccctggacccagaggcagatactgcggggtggtagaaaaggtagagtaggctgtggcaatggaataaaacacgattaaaaacgttaagaactgcgttaaaaaaaaaaaa

SEQ ID NO: 307926 - DNA, 2931 bp, Homo sapiens
agttttaaacgcgcagccgagggccgcgcgcaggagtagggagggcctagggcggcggagccgactcgtcgcggccgaggcgcgcgcggtccgtgccggcgtcagtctgggattggccggcccgcgacttcctccgccccctgccaatcgccggggacgacttccgtgggtttttccggctcccccgcgtcgctaaggagcgacgggctgtcggccagaccccgagttctcggtgcgctcagcggccgccgacgctaggaggccgcgctccgcccccgctaccatgaggccccggaaagccttcctgctcctgctgctcttggggctggtgcagctgctggccgtggcgggtgccgagggcccggacgaggattcttctaacagagaaaatgccattgaggatgaagaggaggaggaggaggaagatgatgatgaggaagaagacgacttggaagttaaggaagaaaatggagtcttggtcctaaatgatgcaaactttgataattttgtggctgacaaagacacagtgctgctggagttttatgctccatggtgtggacattgcaagcagtttgctccggaatatgaaaaaattgccaacatattaaaggataaagatcctcccattcctgttgccaagatcgatgcaacctcagcgtctgtgctggccagcaggtttgatgtgagtggctaccccaccatcaagatccttaagaaggggcaggctgtagactacgagggctccagaacccaggaagaaattgttgccaaggtcagagaagtctcccagcccgactggacgcctccaccagaagtcacgcttgtgttgaccaaagagaactttgatgaagttgtgaatgatgcagatatcattctggtggagttttatgccccatggtgtggacactgcaagaaacttgcccccgagtatgagaaggccgccaaggagctcagcaagcgttctcctccaattcccctggcaaaggtcgacgccaccgcagaaacagacctggccaagaggtttgatgtctctggctatcccaccctgaaaattttccgcaaaggaaggccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccagggctccacccaggactcggccatcaaggacttcgtgctgaagtacgccctgcccctggttggccaccgcaaggtgtcaaacgatgctaagcgctacaccaggcgccccctggtggtcgtctactacagtgtggacttcagctttgattacagagctgcaactcagttttggcggagcaaagtcctagaggtggccaaggacttccctgagtacacctttgccattgcggacgaagaggactatgctggggaggtgaaggacctggggctcagcgagagtggggaggatgtcaatgccgccatcctggacgagagtgggaagaagttcgccatggagccagaggagtttgactctgacaccctccgcgagtttgtcactgctttcaaaaaaggaaaactgaagccagtcatcaaatcccagccagtgcccaagaacaacaagggacccgtcaaggtcgtggtgggaaagacctttgactccattgtgatggaccccaagaaggacgtcctcatcgagttctacgcgccatggtgcgggcactgcaagcagctagagcccgtgtacaacagcctggccaagaagtacaagggccgtccccagcgaccgctataaggtggagggcttccccaccatctacttcgcccccagtggggacaaaaagaacccagttaaatttgagggtggagacagagatctggagcatttgagcaagtttatagaagaacatgccacaaaactgagcaggaccaaggaagagctttgaaggcctgaggtctgcggaaggtgggaggaggcagacgccctgcgtggcccatggtcggggcgtccacgccgaggccggcaacaaacgacagtatctcggattcctttttttttttttttaattttttatactttggtgtttcacttcatgctctgaatactgaataaccatgaatgactgaatagtttagtccagatttttacagaggatacatctatttttatcattatttggggtttgaaaaatttttttttacaccttctaatttctttatttctcaaagcagataattcttctgtgtgaaaatgttttctttttttaatttaaggtttaaaattccttttccaaatcatgttgattttgctctttgctttttcgttgtctgagaaattgttggcgtagatttggcttctggtatgtgtttctgattgcttcctgttgagcacaaagtgagagctgccactgagcagccctgccaggggtgctgtttcaggctgggcatcgccaggcggcctccctgcaaaccaagggctgggggcaaaggggcatgatccagggtcccccagggtgggctcagctccagggagaggccacccacgtggcagccccacctcttgagagcccccagtgccggagcagaaaggaccctggacccagaggcagatactgcggggtggtagaaaaggtagagtaggctgtggcaatggaataaaacacgattaaaaacgttaagaactgcgttaaaaaaaaaaaa

SEQ ID NO: 307927 - DNA, 2083 bp, Homo sapiens
gaggtcacgctcatatctctccatctctttgcttaattctctccggccgccaaggagctcagcaagcgttctcctccaattcccctggcaaaggtcgacgccaccgcagaaacagacctggccaagaggtttgatgtctctggctatcccaccctgaaaattttccgcaaaggaaggccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccagggctccacccaggactcggccatcaaggacttcgtgctgaagtacgccctgcccctggttggccaccgcaaggtgtcaaacgatgctaagcgctacaccaggcgccccctggtggtcgtctactacagtgtggacttcagctttgattacagagctgcaactcagttttggcggagcaaagtcctagaggtggccaaggacttccctgagtacacctttgccattgcggacgaagaggactatgctggggaggtgaaggacctggggctcagcgagagtggggaggatgtcaatgccgccatcctggacgagagtgggaagaagttcgccatggagccagaggagtttgactctgacaccctccgcgagtttgtcactgctttcaaaaaaggaaaactgaagccagtcatcaaatcccagccagtgcccaagaacaacaagggacccgtcaaggtcgtggtgggaaagacctttgactccattgtgatggaccccaagaaggacgtcctcatcgagttctacgcgccatggtgcgggcactgcaagcagctagagcccgtgtacaacagcctggccaagaagtacaagggccaaaagggcctggtcatcgccaagatggacgccactgccaacgacgtccccagcgaccgctataaggtggagggcttccccaccatctacttcgcccccagtggggacaaaaagaacccagttaaatttgagggtggagacagagatctggagcatttgagcaagtttatagaagaacatgccacaaaactgagcaggaccaaggaagagctttgaaggcctgaggtctgcggaaggtgggaggaggcagacgccctgcgtggcccatggtcggggcgtccacgccgaggccggcaacaaacgacagtatctcggattcctttttttttttttttaattttttatactttggtgtttcacttcatgctctgaatactgaataaccatgaatgactgaatagtttagtccagatttttacagaggatacatctatttttatcattatttggggtttgaaaaatttttttttacaccttctaatttctttatttctcaaagcagataattcttctgtgtgaaaatgttttctttttttaatttaaggtttaaaattccttttccaaatcatgttgattttgctctttgctttttcgttgtctgagaaattgttggcgtagatttggcttctggtatgtgtttctgattgcttcctgttgagcacaaagtgagagctgccactgagcagccctgccaggggtgctgtttcaggctgggcatcgccaggcggcctccctgcaaaccaagggctgggggcaaaggggcatgatccagggtcccccagggtgggctcagctccagggagaggccacccacgtggcagccccacctcttgagagcccccagtgccggagcagaaaggaccctggacccagaggcagatactgcggggtggtagaaaaggtagagtaggctgtggcaatggaataaaacacgattaaaaacgttaagaactgcgttaaaaaaaaaaaa

SEQ ID NO: 307928 - DNA, 1791 bp, Homo sapiens
ggctgatgtgggtaacgaattaaatctcagacatttaggcaattttcaaaattacatcttattctgttaacgtttcagctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccagggctccacccaggactcggccatcaaggacttcgtgctgaagtacgccctgcccctggttggccaccgcaaggtgtcaaacgatgctaagcgctacaccaggcgccccctggtggtcgtctactacagtgtggacttcagctttgattacagagctgcaactcagttttggcggagcaaagtcctagaggtggccaaggacttccctgagtacacctttgccattgcggacgaagaggactatgctggggaggtgaaggacctggggctcagcgagagtggggaggatgtcaatgccgccatcctggacgagagtgggaagaagttcgccatggagccagaggagtttgactctgacaccctccgcgagtttgtcactgctttcaaaaaaggaaaactgaagccagtcatcaaatcccagccagtgcccaagaacaacaagggacccgtcaaggtcgtggtgggaaagacctttgactccattgtgatggaccccaagaaggacgtcctcatcgagttctacgcgccatggtgcgggcactgcaagcagctagagcccgtgtacaacagcctggccaagaagtacaagggccaaaagggcctggtcatcgccaagatggacgccactgccaacgacgtccccagcgaccgctataaggtggagggcttccccaccatctacttcgcccccagtggggacaaaaagaacccagttaaatttgagggtggagacagagatctggagcatttgagcaagtttatagaagaacatgccacaaaactgagcaggaccaaggaagagctttgaaggcctgaggtctgcggaaggtgggaggaggcagacgccctgcgtggcccatggtcggggcgtccacgccgaggccggcaacaaacgacagtatctcggattcctttttttttttttttaattttttatactttggtgtttcacttcatgctctgaatactgaataaccatgaatgactgaatagtttagtccagatttttacagaggatacatctatttttatcattatttggggtttgaaaaatttttttttacaccttctaatttctttatttctcaaagcagataattcttctgtgtgaaaatgttttctttttttaatttaaggtttaaaattccttttccaaatcatgttgattttgctctttgctttttcgttgtctgagaaattgttggcgtagatttggcttctggtatgtgtttctgattgcttcctgttgagcacaaagtgagagctgccactgagcagccctgccaggggtgctgtttcaggctgggcatcgccaggcggcctccctgcaaaccaagggctgggggcaaaggggcatgatccagggtcccccagggtgggctcagctccagggagaggccacccacgtggcagccccacctcttgagagcccccagtgccggagcagaaaggaccctggacccagaggcagatactgcggggtggtagaaaaggtagagtaggctgtggcaatggaataaaacacgattaaaaacgttaagaactgcgttaaaaaaaaaaaa

SEQ ID NO: 307929 - DNA, 1264 bp, Homo sapiens
gactctagcaggatctctcataggttcgcaggcatggagccagaggagtttgactctgacaccctccgcgagtttgtcactgctttcaaaaaaggaaaactgaagccagtcatcaaatcccagccagtgcccaagaacaacaagggacccgtcaaggtcgtggtgggaaagacctttgactccattgtgatggaccccaagaaggacgtcctcatcgagttctacgcgccatggtgcgggcactgcaagcagctagagcccgtgtacaacagcctggccaagaagtacaagggccaaaagggcctggtcatcgccaagatggacgccactgccaacgacgtccccagcgaccgctataaggtggagggcttccccaccatctacttcgcccccagtggggacaaaaagaacccagttaaatttgagggtggagacagagatctggagcatttgagcaagtttatagaagaacatgccacaaaactgagcaggaccaaggaagagctttgaaggcctgaggtctgcggaaggtgggaggaggcagacgccctgcgtggcccatggtcggggcgtccacgccgaggccggcaacaaacgacagtatctcggattcctttttttttttttttaattttttatactttggtgtttcacttcatgctctgaatactgaataaccatgaatgactgaatagtttagtccagatttttacagaggatacatctatttttatcattatttggggtttgaaaaatttttttttacaccttctaatttctttatttctcaaagcagataattcttctgtgtgaaaatgttttctttttttaatttaaggtttaaaattccttttccaaatcatgttgattttgctctttgctttttcgttgtctgagaaattgttggcgtagatttggcttctggtatgtgtttctgattgcttcctgttgagcacaaagtgagagctgccactgagcagccctgccaggggtgctgtttcaggctgggcatcgccaggcggcctccctgcaaaccaagggctgggggcaaaggggcatgatccagggtcccccagggtgggctcagctccagggagaggccacccacgtggcagccccacctcttgagagcccccagtgccggagcagaaaggaccctggacccagaggcagatactgcggggtggtagaaaaggtagagtaggctgtggcaatggaataaaacacgattaaaaacgttaagaactgcgttaaaaaaaaaaaa

SEQ ID NO: 307930 - DNA, 1090 bp, Homo sapiens
agttttaaacgcgcagccgagggccgcgcgcaggagtagggagggcctagggcggcggagccgactcgtcgcggccgaggcgcgcgcggtccgtgccggcgtcagtctgggattggccggcccgcgacttcctccgccccctgccaatcgccggggacgacttccgtgggtttttccggctcccccgcgtcgctaaggagcgacgggctgtcggccagaccccgagttctcggtgcgctcagcggccgccgacgctaggaggccgcgctccgcccccgctaccatgaggccccggaaagccttcctgctcctgctgctcttggggctggtgcagctgctggccgtggcgggtgccgagggcccggacgaggattcttctaacagagaaaatgccattgaggatgaagaggaggaggaggaggaagatgatgatgaggaagaagacgacttggaagttaaggaagaaaatggagtcttggtcctaaatgatgcaaactttgataattttgtggctgacaaagacacagtgctgctggagttttatgctccatggtgtggacattgcaagcagtttgctccggaatatgaaaaaattgccaacatattaaaggataaagatcctcccattcctgttgccaagatcgatgcaacctcagcgtctgtgctggccagcaggtttgatgtgagtggctaccccaccatcaagatccttaagaaggggcaggctgtagactacgagggctccagaacccaggaagaaattgttgccaaggtcagagaagtctcccagcccgactggacgcctccaccagaagtcacgcttgtgttgaccaaagagaactttgatgaagttgtgaatgatgcagatatcattctggtggagttttatgccccatggtgtggacactgcaagaaacttgcccccgagtatgagaaggccgccaaggagctcagcaagcgttctcctccaattcccctggcaaaggtcgacgccaccgcagaaacagacctggccaagaggtttgatgtctctggctatcccaccctgaaaattttctcgtgggccgttgtagtcataaggcccctcgtg

SEQ ID NO: 307931 - DNA, 1336 bp, Homo sapiens
  misc_feature (1325)..(1325): n is a, c, g, or t
agttttaaacgcgcagccgagggccgcgcgcaggagtagggagggcctagggcggcggagccgactcgtcgcggccgaggcgcgcgcggtccgtgccggcgtcagtctgggattggccggcccgcgacttcctccgccccctgccaatcgccggggacgacttccgtgggtttttccggctcccccgcgtcgctaaggagcgacgggctgtcggccagaccccgagttctcggtgcgctcagcggccgccgacgctaggaggccgcgctccgcccccgctaccatgaggccccggaaagccttcctgctcctgctgctcttggggctggtgcagctgctggccgtggcgggtgccgagggcccggacgaggattcttctaacagagaaaatgccattgaggatgaagaggaggaggaggaggaagatgatgatgaggaagaagacgacttggaagttaaggaagaaaatggagtcttggtcctaaatgatgcaaactttgataattttgtggctgacaaagacacagtgctgctggagttttatgctccatggtgtggacattgcaagcagtttgctccggaatatgaaaaaattgccaacatattaaaggataaagatcctcccattcctgttgccaagatcgatgcaacctcagcgtctgtgctggccagcaggtttgatgtgagtggctaccccaccatcaagatccttaagaaggggcaggctgtagactacgagggctccagaacccaggaagatggagtcttcctctgtctcccaggctggagtgtgcagtggtgcaatcttggctcaccgaacagcctccacctccggggttcagaaattgttgccaaggtcagagaagtctcccagcccgactggacgcctccaccagaagtcacgcttgtgttgaccaaagagaactttgatgaagttgtgaatgatgcagatatcattctggtggagttttatgccccatggtgtggacactgcaagaaacttgcccccgagtatgagaaggccgccaaggagctcagcaagcgttctcctccaattcccctggcaaaggtcgacgccaccgcagaaacagacctggccaagaggtttgatgtctctggctatcccaccctgaaaattttccgcaaaggaaggccttatgactacaacggcccacgagaaaaatatggagattctgaccctgaagcaggtccaggagttcctgaaggatggagacgatgtcatcatcatcggggtctttaagggggagagtgacccagcctaccagcaataccaggatgccgttaacaacctgagaggataccanatttcacccct

SEQ ID NO: 307932 - DNA, 2937 bp, Homo sapiens
  misc_feature (49)..(49): n is a, c, g, or t
gcttctgggaggaggccttttcttgacagtttagggtagcgggggaatngatgatccgggagtcccctgcggatgtcgtcccgcaccaggccgggaccgatttctggctccagtttccccagaattgcggagtgcgcacacctggaaggacccaagtcccgttttatagttgagaaactcaagactcagacaagtgaaacgacttttgcttcatgacagctggaactggaacccagttcccttttagactatggcgacatacctggagttcatccagcagaatgaagaacgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttgtcaggttgattatcgagcaaaactttgggcctgtaatttctgttttcaaagaaatcagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcagatttctgcagcctgttcacaagattgatatgaacctcactgatcttcttggggagctacagagggacccatggccagtaactcaggggaagagacctttgcgatccactggtgtggctttgtccattgctgttggcttgctggagggcacttttccaaacacaggagccaggatcatgctgtttactggaggtccccctacccaagggcctggcatggtggttggagatgaattaaagattcctattcgttcttggcatgatattgagaaagataatgcacgattcatgaaaaaggcaaccaagcactatgagatgcttgctaatcgaacagctgcaaatggtcactgcattgatatttatgcttgtgcccttgatcaaactggacttttggagatgaagtgttgtgcaaatcttactggaggctacatggtaatgggagattctttcaacacttctctcttcaagcagacattccaaagaatctttactaaagattttaatggagatttccgaatggcatttggtgctactttggacgtaaagacctctcgggaactgaagattgcaggagccattggtccatgcgtatctctgaatgtgaaaggaccgtgtgtgtcagaaaatgagcttggtgttggtggcacgagtcagtggaaaatctgtggcctagatcctacatctacacttggcatctattttgaagttgtcaatcagcacaacaccccgatcccccaaggaggcagaggagccatccagtttgtcacgcattatcagcactccagcacccagagacgcatccgcgtgaccaccatcgcccgaaattgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactgtgtcaaaagtttggacagtataacaaagaagaccccacttcttttaggttatcagattccttttctctatatcctcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagagccagtactcttggatagcagcagcattctagctgacagaattttgctgatggatactttctttcaaattgtcatttatcttggtgagaccatagcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagtcaggctcgattccttttgtccaaagtgaacccatctcagacacacaataacctgtatgcttggggacaggaaactggagcacccatcctaactgatgatgttagcctgcaggtgttcatggaccatttgaagaagctggctgtctccagtgcctgttaagctgaggatacaaccaggaaatgcaacggtgtcagattgtgttcaaaatgtctagaaaggcttgataacattcctgttacttttctagcagattttaacaaataatcaaggacattttatatgtaactctttagattataatttatttgtattcctgtctttgtcctttttcttgcactataaaattataaggtcataaatgttttggtacttgtagatgtttatgtgctttttgtatcctaacttttagaatctaaataaaatcagaggtaatgtattttggcagcttgtttaggtgagaatcttaatgatcataaaaggaaataaatctagatgcagaaagtactggctaaaatattgctaatacaaatgtgatttcctga

SEQ ID NO: 307933 - DNA, 2776 bp, Homo sapiens
aatgccttcttccggcagccttagtttcttccaaccagtgcagctccctgttccgcgagcatacgtcatcgttctcgctttccggtagctaaggcgatcagcgggacttcccactgagacgagcggatgtcatattgtatcagggcgaacctctgaggagcgctggctgcgcttaggcaacgttcccttttagactatggcgacatacctggagttcatccagcagaatgaagaacgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttgtcaggttgattatcgagcaaaactttgggcctgtaatttctgttttcaaagaaatcagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcagatttctgcagcctgttcacaagattgatatgaacctcactgatcttcttggggagctacagagggacccatggccagtaactcaggggaagagacctttgcgatccactggtgtggctttgtccattgctgttggcttgctggagggcacttttccaaacacaggagccaggatcatgctgtttactggaggtccccctacccaagggcctggcatggtggttggagatgaattaaagattcctattcgttcttggcatgatattgagaaagataatgcacgattcatgaaaaaggcaaccaagcactatgagatgcttgctaatcgaacagctgcaaatggtcactgcattgatatttatgcttgtgcccttgatcaaactggacttttggagatgaagtgttgtgcaaatcttactggaggctacatggtaatgggagattctttcaacacttctctcttcaagcagacattccaaagaatctttactaaagattttaatggagatttccgaatggcatttggtgctactttggacgtaaagacctctcgggaactgaagattgcaggagccattggtccatgcgtatctctgaatgtgaaaggaccgtgtgtgtcagaaaatgagcttggtgttggtggcacgagtcagtggaaaatctgtggcctagatcctacatctacacttggcatctattttgaagttgtcaatcagcacaacaccccgatcccccaaggaggcagaggagccatccagtttgtcacgcattatcagcactccagcacccagagacgcatccgcgtgaccaccatcgcccgaaattgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactgtgtcaaaagtttggacagtataacaaagaagaccccacttcttttaggttatcagattccttttctctatatcctcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagagccagtactcttggatagcagcagcattctagctgacagaattttgctgatggatactttctttcaaattgtcatttatcttggtgagaccatagcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagtcaggctcgattccttttgtccaaagtgaacccatctcagacacacaataacctgtatgcttggggacaggaaactggagcacccatcctaactgatgatgttagcctgcaggtgttcatggaccatttgaagaagctggctgtctccagtgcctgttaagctgaggatacaaccaggaaatgcaacggtgtcagattgtgttcaaaatgtctagaaaggcttgataacattcctgttacttttctagcagattttaacaaataatcaaggacattttatatgtaactctttagattataatttatttgtattcctgtctttgtcctttttcttgcactataaaattataaggtcataaatgttttggtacttgtagatgtttatgtgctttttgtatcctaacttttagaatctaaataaaatcagaggtaatgt

SEQ ID NO: 307934 - DNA, 715 bp, Homo sapiens
gcctgatgctcaaaactagcaggcggtggtggcctgatctcggcgtaccaggaaaggattttgtgaggaaattgtgctttagtcaaaagaagttgttcgtgaggcagaggatggggtgatgggagtactcgtagcagaggggacaacacctgtgaatgttctgagggaaggtgcttgacagctcatgaattctaatcagcttctaagatatctgccaactaatctttatcattacatttcaggaaactggagcacccatcctaactgatgatgttagcctgcaggtgttcatggaccatttgaagaagctggctgtctccagtgcctgttaagctgaggatacaaccaggaaatgcaacggtgtcagattgtgttcaaaatgtctagaaaggcttgataacattcctgttacttttctagcagattttaacaaataatcaaggacattttatatgtaactctttagattataatttatttgtattcctgtctttgtcctttttcttgcactataaaattataaggtcataaatgttttggtacttgtagatgtttatgtgctttttgtatcctaacttttagaatctaaataaaatcagaggtaatgtattttggcagcttgtttaggtgagaatcttaatgatcataaaaggaaataaatctagatgcagaaagtactggctaaaatattgctaatacaaatgtgatttcctga

SEQ ID NO: 307935 - DNA, 1014 bp, Homo sapiens
gcctgatgctcaaaactagcaggcggtggtggcctgatctcggcgtaccaggaaaggattttgtgaggaaattgtgctttagtcaaaagaagttgttcgtgaggcagaggatggggtgatgggagtactcgtagcagaggggacaacacctgtgaatgttctgagggaaggtgcttgacagctcatgaattctaatcagcttctaagatatctgccaactaatctttatcattacatttcaggaaactggagcacccatcctaactgatgatgttagcctgcaggtgttcatggaccatttgaagaagctggctgtctccagtgcctgttaagctgaggatacaaccaggaaatgcaacggtgtcagattgtgttcaaaatgtctagaaaggcttgataacattcctgttacttttctagcagattttaacaaataatcaaggacattttatatgtaactctttagattataatttatttgtattcctgtctttgtcctttttcttgcactataaaattataaggtcataaatgttttggtacttgtagatgtttatgtgctttttgtatcctaacttttagaatctaaataaaatcagaggtaatgtattttggcagcttgtttaggtgagaatcttaatgatcataaaaggaaataaatctagatgcagaaagtactggctaaaatattgctaatacaaatgtgatttcctgaggtctctgtgtgagtgtgtatgtgttttaagtgacttccttaagaggtgtttcctgaacctaattctcataattaaagtaatgtatatgcaggatcaaaatgaaacaaatataccttatcctaaagagctcataacaaataagttacctccactctataaactcagacctactttttgaagataactgcttttaacctctccttacaagatttttgttgttgatgtatttaattttagcccatgtctcaattctcattttcaaagaatcaatatattaatatacctttggtcaaatttg

SEQ ID NO: 307936 - DNA, 1069 bp, Homo sapiens
tagtatagtgcgggcgggtgtatcagcacggggctggcttatgtgaggggagcggagcctgcttgttgcagctgtgggtgaggacggctctagctaggtgagcggctccggccagttcccttttagactatggcgacatacctggagttcatccagcagaatgaagaacgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttgtcaggttgattatcgagcaaaactttgggcctgtaatttctgttttcaaagaaatcagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcagattctgacggctgtcccagatgtatgaactcactgatcttctgggggagctacagggggccaggcagcaccaagggaaggaccttggagccagggggcttggcctggcgcggcgagggcttacaaccggagcgccgggtcggggcccacaggcgacgggggagaacaaacacacgcggaatgaaaacgcgcggaaggacgaagaataaagagcggcaacggcacacgagagggcgggagtccaactccggg

SEQ ID NO: 307937 - DNA, 1035 bp, Homo sapiens
tgtttaactacatgtagtttggagatgatcaggtgattgtaaacctcccactcctttgatttatttttaagtgcttgaaaggagaggtgagaaaggagcagtgatcaatgataactgtgcggttaactgacttttgggtatcagatggaaaagaaatactgtcattctacagcaacaggttcttcccaagtatttaagaaacactgtgttagttgggccgggtacagtgggtcacgcctgtaatcccagcactttggaaggccaaggcgggtggatcacctgaggtcaggagtttgagaccagcctggccaacatggtgaaaccctgcctctactaaaaatacaaaaaattagccgggcttggtggcacaggcttgtaatcccagctacttgggaggctgtggcaggagaatcgcttgaacccgggaggtggaggctgcagtgagctgagatgggaaaaaaagagaaacactgtgttacatgacccatcttctttttttgacatttagttcagaatttcacataccattaaggtaattaaagttttatcttcagttcccttttagactatggcgacatacctggagttcatccagcagaatgaagaacgggatggtgtgcgttttagttggaacgtgtggccttccagccggctggaggatacaaccaggaaatgcaacggtgtcagattgtgttcaaaatgtctagaaaggcttgataacattcctgttacttttctagcagattttaacaaataatcaaggacattttatatgtaactctttagattataatttatttgtattcctgtctttgtcctttttcttgcactataaaattataaggtcataaatgttttggtacttgtagatgtttatgtgctttttgtatcctaacttttagaatctaaataaaatcagaggtaatgtattttggcagcttgtttaggtgagaatcttaatgatcataaaaggaaataaatctagatgcagaaagtactggctaaaatattgctaatacaaatgtgatttcctga

SEQ ID NO: 307938 - DNA, 608 bp, Homo sapiens
gcctgatgctcaaaactagcaggcggtggtggcctgatctcggcgtaccaggaaaggattttgtgaggaaattgtgctttagtcaaaagaagttgttcgtgaggcagaggatggggtgatgggagtactcgtagcagaggggacaacacctgtgaatgttctgagggaaggtgcttgacagctcatgaattctaatcagcttctaagatatctgccaactaatctttatcattacatttcaggaaactggagcacccatcctaactgatgatgttagcctgcaggtgttcatggaccatttgaagaagctggctgtctccagtgcctgttaagctgaggatacaaccaggaaatgcaacggtgtcagattgtgttcaaaatgtctagaaaggcttgataacattcctgttacttttctagcagattttaacaaataatcaaggacattttatatgtaactctttagattataatttatttgtattcctgtctttgtcctttttcttgcactataaaattataaggtcataaatgttttggtacttgtagatgtttatgtgctttttgtatcctaacttttagaatctaaataaaatcagaggtaatgt

SEQ ID NO: 307939 - DNA, 639 bp, Homo sapiens
  misc_feature (237)..(237): n is a, c, g, or t
  misc_feature (249)..(249): n is a, c, g, or t
  misc_feature (258)..(261): n is a, c, g, or t
  misc_feature (265)..(265): n is a, c, g, or t
  misc_feature (273)..(273): n is a, c, g, or t
  misc_feature (280)..(280): n is a, c, g, or t
  misc_feature (285)..(285): n is a, c, g, or t
  misc_feature (331)..(331): n is a, c, g, or t
  misc_feature (347)..(347): n is a, c, g, or t
cccgcgccgcgggggtgcccgctgaacgcgccgtccagctgcagctgcagtcgctctagagatcccgaggcgtccgaatggcattggtgctactttggacgtaagacttctcgggaactgaagattgcaggagccattggtccatgcgtatctctgaatgtgaaaggaccgtgtgtgtcagaaaatgagcttggtgttggtggcacgagtcagtggaaaatctgtggcctagatccnacatctacactnggcatctannnngaanttgtcaancagcacnacacnccgatcccccaaggaggcagaggagccatccagtttgtcacgcatnatcagcactccagcanccagagacgcatccgcgtgaccaccatcgcccgaaagagcttggtgttggtggcacgagtcagtggaaaatctgtggcctagatcctacatctacacttggcatctattttgaagttgtcaatcagcacaacaccccgatcccccaaggaggcagaggagccatccagtttgtcacgcattatcagcactccagcacccagagacgcatccgcgtgaccaccatcgcccgaaagagcttggtgttggtggcacgagtcagtggaaaatctgtggcctagatcctaatctaca

SEQ ID NO: 307940 - DNA, 385 bp, Homo sapiens
  misc_feature (49)..(49): n is a, c, g, or t
gcttctgggaggaggccttttcttgacagtttagggtagcgggggaatngatgatccgggagtcccctgcggatgtcgtcccgcaccaggccgggaccgatttctggctccagtttccccagaattgcggagtgcgcacacctggaaggacccaagtcccgttttatagttgagaaactcaagactcagacaagtgaaacgacttttgcttcatgacagctggaactggaacccaggtccttggactcccttcaaggattaaacctcacttattcttacatacacatggtcactgtgtcctgagaagttacgagttggcgcgataagggtggttcagattttttggcatattctcctgttatctttccaggcctttcattcattc

SEQ ID NO: 307941 - DNA, 2749 bp, Homo sapiens
gcaagcacagacgcgcgacacaagggatgtagacgtgcgtcgccgggttgtaatttcatcacgagagctgagctggacttggcggtgggagccggagcctgcttgttgcagctgtgggtgaggacggctctagctaggtgagcggctccggccagttcccttttagactatggcgacatacctggagttcatccagcagaatgaagaacgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttgtcaggttgattatcgagcaaaactttgggcctgtaatttctgttttcaaagaaatcagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcagatttctgcagcctgttcacaagattgatatgaacctcactgatcttcttggggagctacagagggacccatggccagtaactcaggggaagagacctttgcgatccactggtgtggctttgtccattgctgttggcttgctggagggcacttttccaaacacaggagccaggatcatgctgtttactggaggtccccctacccaagggcctggcatggtggttggagatgaattaaagattcctattcgttcttggcatgatattgagaaagataatgcacgattcatgaaaaaggcaaccaagcactatgagatgcttgctaatcgaacagctgcaaatggtcactgcattgatatttatgcttgtgcccttgatcaaactggacttttggagatgaagtgttgtgcaaatcttactggaggctacatggtaatgggagattctttcaacacttctctcttcaagcagacattccaaagaatctttactaaagattttaatggagatttccgaatggcatttggtgctactttggacgtaaagacctctcgggaactgaagattgcaggagccattggtccatgcgtatctctgaatgtgaaaggaccgtgtgtgtcagaaaatgagcttggtgttggtggcacgagtcagtggaaaatctgtggcctagatcctacatctacacttggcatctattttgaagttgtcaatcagcacaacaccccgatcccccaaggaggcagaggagccatccagtttgtcacgcattatcagcactccagcacccagagacgcatccgcgtgaccaccatcgcccgaaattgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactgtgtcaaaagtttggacagtataacaaagaagaccccacttcttttaggttatcagattccttttctctatatcctcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagagccagtactcttggatagcagcagcattctagctgacagaattttgctgatggatactttctttcaaattgtcatttatcttggtgagaccatagcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagtcaggctcgattccttttgtccaaagtgaacccatctcagacacacaataacctgtatgcttggggacaggaaactggagcacccatcctaactgatgatgttagcctgcaggtgttcatggaccatttgaagaagctggctgtctccagtgcctgttaagctgaggatacaaccaggaaatgcaacggtgtcagattgtgttcaaaatgtctagaaaggcttgataacattcctgttacttttctagcagattttaacaaataatcaaggacattttatatgtaactctttagattataatttatttgtattcctgtctttgtcctttttcttgcactataaaattataaggtcataaatgttttggtacttgtagatgtttatgtgctttttgtatcctaacttttagaatctaaataaaatcagaggtaatgt

SEQ ID NO: 307942 - DNA, 3186 bp, Homo sapiens
aatgccttcttccggcagccttagtttcttccaaccagtgcagctccctgttccgcgagcatacgtcatcgttctcgctttccggtagctaaggcgatcagcgggacttcccactgagacgagcggatgtcatattgtatcagggcgaacctctgaggagcgctggctgcgcttaggcaacggtgcggcaggcgccggggttttctgaaacagaaacgtttaggggtggggaaacgtgttccgaggaactctcgttttgaagtgcgagatacacctgtcttgccctgttccaagatggtggcagagcttctctgagtctctcgcttcctccagtccgtcggagaagcgctctttgattggccagtggacagcgccgtggcatgacgcgctggggcgctggccaatcggttgagagctgagctggacttggcggtgggagccggagcctgcttgttgcagctgtgggtgaggacggctctagctagttcccttttagactatggcgacatacctggagttcatccagcagaatgaagaacgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttgtcaggttgattatcgagcaaaactttgggcctgtaatttctgttttcaaagaaatcagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcagatttctgcagcctgttcacaagattgatatgaacctcactgatcttcttggggagctacagagggacccatggccagtaactcaggggaagagacctttgcgatccactggtgtggctttgtccattgctgttggcttgctggagggcacttttccaaacacaggagccaggatcatgctgtttactggaggtccccctacccaagggcctggcatggtggttggagatgaattaaagattcctattcgttcttggcatgatattgagaaagataatgcacgattcatgaaaaaggcaaccaagcactatgagatgcttgctaatcgaacagctgcaaatggtcactgcattgatatttatgcttgtgcccttgatcaaactggacttttggagatgaagtgttgtgcaaatcttactggaggctacatggtaatgggagattctttcaacacttctctcttcaagcagacattccaaagaatctttactaaagattttaatggagatttccgaatggcatttggtgctactttggacgtaaagacctctcgggaactgaagattgcaggagccattggtccatgcgtatctctgaatgtgaaaggaccgtgtgtgtcagaaaatgagcttggtgttggtggcacgagtcagtggaaaatctgtggcctagatcctacatctacacttggcatctattttgaagttgtcaatcagcacaacaccccgatcccccaaggaggcagaggagccatccagtttgtcacgcattatcagcactccagcacccagagacgcatccgcgtgaccaccatcgcccgaaattgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactgtgtcaaaagtttggacagtataacaaagaagaccccacttcttttaggttatcagattccttttctctatatcctcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagagccagtactcttggatagcagcagcattctagctgacagaattttgctgatggatactttctttcaaattgtcatttatcttggtgagaccatagcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagtcaggctcgattccttttgtccaaagtgaacccatctcagacacacaataacctgtatgcttggggacaggaaactggagcacccatcctaactgatgatgttagcctgcaggtgttcatggaccatttgaagaagctggctgtctccagtgcctgttaagctgaggatacaaccaggaaatgcaacggtgtcagattgtgttcaaaatgtctagaaaggcttgataacattcctgttacttttctagcagattttaacaaataatcaaggacattttatatgtaactctttagattataatttatttgtattcctgtctttgtcctttttcttgcactataaaattataaggtcataaatgttttggtacttgtagatgtttatgtgctttttgtatcctaacttttagaatctaaataaaatcagaggtaatgtattttggcagcttgtttaggtgagaatcttaatgatcataaaaggaaataaatctagatgcagaaagtactggctaaaatattgctaatacaaatgtgatttcctga

SEQ ID NO: 307943 - DNA, 3485 bp, Homo sapiens
aatgccttcttccggcagccttagtttcttccaaccagtgcagctccctgttccgcgagcatacgtcatcgttctcgctttccggtagctaaggcgatcagcgggacttcccactgagacgagcggatgtcatattgtatcagggcgaacctctgaggagcgctggctgcgcttaggcaacggtgcggcaggcgccggggttttctgaaacagaaacgtttaggggtggggaaacgtgttccgaggaactctcgttttgaagtgcgagatacacctgtcttgccctgttccaagatggtggcagagcttctctgagtctctcgcttcctccagtccgtcggagaagcgctctttgattggccagtggacagcgccgtggcatgacgcgctggggcgctggccaatcggttgagagctgagctggacttggcggtgggagccggagcctgcttgttgcagctgtgggtgaggacggctctagctagttcccttttagactatggcgacatacctggagttcatccagcagaatgaagaacgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttgtcaggttgattatcgagcaaaactttgggcctgtaatttctgttttcaaagaaatcagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcagatttctgcagcctgttcacaagattgatatgaacctcactgatcttcttggggagctacagagggacccatggccagtaactcaggggaagagacctttgcgatccactggtgtggctttgtccattgctgttggcttgctggagggcacttttccaaacacaggagccaggatcatgctgtttactggaggtccccctacccaagggcctggcatggtggttggagatgaattaaagattcctattcgttcttggcatgatattgagaaagataatgcacgattcatgaaaaaggcaaccaagcactatgagatgcttgctaatcgaacagctgcaaatggtcactgcattgatatttatgcttgtgcccttgatcaaactggacttttggagatgaagtgttgtgcaaatcttactggaggctacatggtaatgggagattctttcaacacttctctcttcaagcagacattccaaagaatctttactaaagattttaatggagatttccgaatggcatttggtgctactttggacgtaaagacctctcgggaactgaagattgcaggagccattggtccatgcgtatctctgaatgtgaaaggaccgtgtgtgtcagaaaatgagcttggtgttggtggcacgagtcagtggaaaatctgtggcctagatcctacatctacacttggcatctattttgaagttgtcaatcagcacaacaccccgatcccccaaggaggcagaggagccatccagtttgtcacgcattatcagcactccagcacccagagacgcatccgcgtgaccaccatcgcccgaaattgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactgtgtcaaaagtttggacagtataacaaagaagaccccacttcttttaggttatcagattccttttctctatatcctcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagagccagtactcttggatagcagcagcattctagctgacagaattttgctgatggatactttctttcaaattgtcatttatcttggtgagaccatagcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagtcaggctcgattccttttgtccaaagtgaacccatctcagacacacaataacctgtatgcttggggacaggaaactggagcacccatcctaactgatgatgttagcctgcaggtgttcatggaccatttgaagaagctggctgtctccagtgcctgttaagctgaggatacaaccaggaaatgcaacggtgtcagattgtgttcaaaatgtctagaaaggcttgataacattcctgttacttttctagcagattttaacaaataatcaaggacattttatatgtaactctttagattataatttatttgtattcctgtctttgtcctttttcttgcactataaaattataaggtcataaatgttttggtacttgtagatgtttatgtgctttttgtatcctaacttttagaatctaaataaaatcagaggtaatgtattttggcagcttgtttaggtgagaatcttaatgatcataaaaggaaataaatctagatgcagaaagtactggctaaaatattgctaatacaaatgtgatttcctgaggtctctgtgtgagtgtgtatgtgttttaagtgacttccttaagaggtgtttcctgaacctaattctcataattaaagtaatgtatatgcaggatcaaaatgaaacaaatataccttatcctaaagagctcataacaaataagttacctccactctataaactcagacctactttttgaagataactgcttttaacctctccttacaagatttttgttgttgatgtatttaattttagcccatgtctcaattctcattttcaaagaatcaatatattaatatacctttggtcaaatttg

SEQ ID NO: 307944 - DNA, 2816 bp, Homo sapiens
tagtatagtgcgggcgggtgtatcagcacggggctggcttatgtgaggggagcggagcctgcttgttgcagctgtgggtgaggacggctctagctaggtgagcggctccggccagttcccttttagactatggcgacatacctggagttcatccagcagaatgaagaacgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttgtcaggttgattatcgagcaaaactttgggcctgtaatttctgttttcaaagaaatcagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcagatttctgcagcctgttcacaagattgatatgaacctcactgatcttcttggggagctacagagggacccatggccagtaactcaggggaagagacctttgcgatccactggtgtggctttgtccattgctgttggcttgctggagggcacttttccaaacacaggagccaggatcatgctgtttactggaggtccccctacccaagggcctggcatggtggttggagatgaattaaagattcctattcgttcttggcatgatattgagaaagataatgcacgattcatgaaaaaggcaaccaagcactatgagatgcttgctaatcgaacagctgcaaatggtcactgcattgatatttatgcttgtgcccttgatcaaactggacttttggagatgaagtgttgtgcaaatcttactggaggctacatggtaatgggagattctttcaacacttctctcttcaagcagacattccaaagaatctttactaaagattttaatggagatttccgaatggcatttggtgctactttggacgtaaagacctctcgggaactgaagattgcaggagccattggtccatgcgtatctctgaatgtgaaaggaccgtgtgtgtcagaaaatgagcttggtgttggtggcacgagtcagtggaaaatctgtggcctagatcctacatctacacttggcatctattttgaagttgtcaatcagcacaacaccccgatcccccaaggaggcagaggagccatccagtttgtcacgcattatcagcactccagcacccagagacgcatccgcgtgaccaccatcgcccgaaattgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactgtgtcaaaagtttggacagtataacaaagaagaccccacttcttttaggttatcagattccttttctctatatcctcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagagccagtactcttggatagcagcagcattctagctgacagaattttgctgatggatactttctttcaaattgtcatttatcttggtgagaccatagcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagtcaggctcgattccttttgtccaaagtgaacccatctcagacacacaataacctgtatgcttggggacaggaaactggagcacccatcctaactgatgatgttagcctgcaggtgttcatggaccatttgaagaagctggctgtctccagtgcctgttaagctgaggatacaaccaggaaatgcaacggtgtcagattgtgttcaaaatgtctagaaaggcttgataacattcctgttacttttctagcagattttaacaaataatcaaggacattttatatgtaactctttagattataatttatttgtattcctgtctttgtcctttttcttgcactataaaattataaggtcataaatgttttggtacttgtagatgtttatgtgctttttgtatcctaacttttagaatctaaataaaatcagaggtaatgtattttggcagcttgtttaggtgagaatcttaatgatcataaaaggaaataaatctagatgcagaaagtactggctaaaatattgctaatacaaatgtgatttcctga

SEQ ID NO: 307945 - DNA, 3079 bp, Homo sapiens
aatgccttcttccggcagccttagtttcttccaaccagtgcagctccctgttccgcgagcatacgtcatcgttctcgctttccggtagctaaggcgatcagcgggacttcccactgagacgagcggatgtcatattgtatcagggcgaacctctgaggagcgctggctgcgcttaggcaacggtgcggcaggcgccggggttttctgaaacagaaacgtttaggggtggggaaacgtgttccgaggaactctcgttttgaagtgcgagatacacctgtcttgccctgttccaagatggtggcagagcttctctgagtctctcgcttcctccagtccgtcggagaagcgctctttgattggccagtggacagcgccgtggcatgacgcgctggggcgctggccaatcggttgagagctgagctggacttggcggtgggagccggagcctgcttgttgcagctgtgggtgaggacggctctagctagttcccttttagactatggcgacatacctggagttcatccagcagaatgaagaacgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttgtcaggttgattatcgagcaaaactttgggcctgtaatttctgttttcaaagaaatcagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcagatttctgcagcctgttcacaagattgatatgaacctcactgatcttcttggggagctacagagggacccatggccagtaactcaggggaagagacctttgcgatccactggtgtggctttgtccattgctgttggcttgctggagggcacttttccaaacacaggagccaggatcatgctgtttactggaggtccccctacccaagggcctggcatggtggttggagatgaattaaagattcctattcgttcttggcatgatattgagaaagataatgcacgattcatgaaaaaggcaaccaagcactatgagatgcttgctaatcgaacagctgcaaatggtcactgcattgatatttatgcttgtgcccttgatcaaactggacttttggagatgaagtgttgtgcaaatcttactggaggctacatggtaatgggagattctttcaacacttctctcttcaagcagacattccaaagaatctttactaaagattttaatggagatttccgaatggcatttggtgctactttggacgtaaagacctctcgggaactgaagattgcaggagccattggtccatgcgtatctctgaatgtgaaaggaccgtgtgtgtcagaaaatgagcttggtgttggtggcacgagtcagtggaaaatctgtggcctagatcctacatctacacttggcatctattttgaagttgtcaatcagcacaacaccccgatcccccaaggaggcagaggagccatccagtttgtcacgcattatcagcactccagcacccagagacgcatccgcgtgaccaccatcgcccgaaattgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactgtgtcaaaagtttggacagtataacaaagaagaccccacttcttttaggttatcagattccttttctctatatcctcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagagccagtactcttggatagcagcagcattctagctgacagaattttgctgatggatactttctttcaaattgtcatttatcttggtgagaccatagcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagtcaggctcgattccttttgtccaaagtgaacccatctcagacacacaataacctgtatgcttggggacaggaaactggagcacccatcctaactgatgatgttagcctgcaggtgttcatggaccatttgaagaagctggctgtctccagtgcctgttaagctgaggatacaaccaggaaatgcaacggtgtcagattgtgttcaaaatgtctagaaaggcttgataacattcctgttacttttctagcagattttaacaaataatcaaggacattttatatgtaactctttagattataatttatttgtattcctgtctttgtcctttttcttgcactataaaattataaggtcataaatgttttggtacttgtagatgtttatgtgctttttgtatcctaacttttagaatctaaataaaatcagaggtaatgt

SEQ ID NO: 307946 - DNA, 2883 bp, Homo sapiens
aatgccttcttccggcagccttagtttcttccaaccagtgcagctccctgttccgcgagcatacgtcatcgttctcgctttccggtagctaaggcgatcagcgggacttcccactgagacgagcggatgtcatattgtatcagggcgaacctctgaggagcgctggctgcgcttaggcaacgttcccttttagactatggcgacatacctggagttcatccagcagaatgaagaacgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttgtcaggttgattatcgagcaaaactttgggcctgtaatttctgttttcaaagaaatcagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcagatttctgcagcctgttcacaagattgatatgaacctcactgatcttcttggggagctacagagggacccatggccagtaactcaggggaagagacctttgcgatccactggtgtggctttgtccattgctgttggcttgctggagggcacttttccaaacacaggagccaggatcatgctgtttactggaggtccccctacccaagggcctggcatggtggttggagatgaattaaagattcctattcgttcttggcatgatattgagaaagataatgcacgattcatgaaaaaggcaaccaagcactatgagatgcttgctaatcgaacagctgcaaatggtcactgcattgatatttatgcttgtgcccttgatcaaactggacttttggagatgaagtgttgtgcaaatcttactggaggctacatggtaatgggagattctttcaacacttctctcttcaagcagacattccaaagaatctttactaaagattttaatggagatttccgaatggcatttggtgctactttggacgtaaagacctctcgggaactgaagattgcaggagccattggtccatgcgtatctctgaatgtgaaaggaccgtgtgtgtcagaaaatgagcttggtgttggtggcacgagtcagtggaaaatctgtggcctagatcctacatctacacttggcatctattttgaagttgtcaatcagcacaacaccccgatcccccaaggaggcagaggagccatccagtttgtcacgcattatcagcactccagcacccagagacgcatccgcgtgaccaccatcgcccgaaattgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactgtgtcaaaagtttggacagtataacaaagaagaccccacttcttttaggttatcagattccttttctctatatcctcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagagccagtactcttggatagcagcagcattctagctgacagaattttgctgatggatactttctttcaaattgtcatttatcttggtgagaccatagcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagtcaggctcgattccttttgtccaaagtgaacccatctcagacacacaataacctgtatgcttggggacaggaaactggagcacccatcctaactgatgatgttagcctgcaggtgttcatggaccatttgaagaagctggctgtctccagtgcctgttaagctgaggatacaaccaggaaatgcaacggtgtcagattgtgttcaaaatgtctagaaaggcttgataacattcctgttacttttctagcagattttaacaaataatcaaggacattttatatgtaactctttagattataatttatttgtattcctgtctttgtcctttttcttgcactataaaattataaggtcataaatgttttggtacttgtagatgtttatgtgctttttgtatcctaacttttagaatctaaataaaatcagaggtaatgtattttggcagcttgtttaggtgagaatcttaatgatcataaaaggaaataaatctagatgcagaaagtactggctaaaatattgctaatacaaatgtgatttcctga

SEQ ID NO: 307947 - DNA, 2769 bp, Homo sapiens
gcaagcacagacgcgcgacacaagggatgtagacgtgcgtcgccgggttgtaatttcatcacgagagctgagctggacttggcggtgggagccggagcctgcttgttgcagctgtgggtgaggacggctctagctaggtgagcggctccggccagttcccttttagactatggcgacatacctggagttcatccagcagaatgaagaacgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttgtcaggttgattatcgagcaaaactttgggcctgtaatttctgttttcaaagaaatcagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcagatttctgcagcctgttcacaagattgatatgaacctcactgatcttcttggggagctacagagggacccatggccagtaactcaggggaagagacctttgcgatccactggtgtggctttgtccattgctgttggcttgctggagggcacttttccaaacacaggagccaggatcatgctgtttactggaggtccccctacccaagggcctggcatggtggttggagatgaattaaagattcctattcgttcttggcatgatattgagaaagataatgcacgattcatgaaaaaggcaaccaagcactatgagatgcttgctaatcgaacagctgcaaatggtcactgcattgatatttatgcttgtgcccttgatcaaactggacttttggagatgaagtgttgtgcaaatcttactggaggctacatggtaatgggagattctttcaacacttctctcttcaagcagacattccaaagaatctttactaaagattttaatggagatttccgaatggcatttggtgctactttggacgtaaagacctctcgggaactgaagattgcaggagccattggtccatgcgtatctctgaatgtgaaaggaccgtgtgtgtcagaaaatgagcttggtgttggtggcacgagtcagtggaaaatctgtggcctagatcctacatctacacttggcatctattttgaagttgtcaatcagcacaacaccccgatcccccaaggaggcagaggagccatccagtttgtcacgcattatcagcactccagcacccagagacgcatccgcgtgaccaccatcgcccgaaattgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactgtgtcaaaagtttggacagtataacaaagaagaccccacttcttttaggttatcagattccttttctctatatcctcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagagaccatagcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagtcaggctcgattccttttgtccaaagtgaacccatctcagacacacaataacctgtatgcttggggacaggaaactggagcacccatcctaactgatgatgttagcctgcaggtgttcatggaccatttgaagaagctggctgtctccagtgcctgttaagctgaggatacaaccaggaaatgcaacggtgtcagattgtgttcaaaatgtctagaaaggcttgataacattcctgttacttttctagcagattttaacaaataatcaaggacattttatatgtaactctttagattataatttatttgtattcctgtctttgtcctttttcttgcactataaaattataaggtcataaatgttttggtacttgtagatgtttatgtgctttttgtatcctaacttttagaatctaaataaaatcagaggtaatgtattttggcagcttgtttaggtgagaatcttaatgatcataaaaggaaataaatctagatgcagaaagtactggctaaaatattgctaatacaaatgtgatttcctga

SEQ ID NO: 307948 - DNA, 2345 bp, Homo sapiens
  misc_feature (237)..(237): n is a, c, g, or t
  misc_feature (249)..(249): n is a, c, g, or t
  misc_feature (258)..(261): n is a, c, g, or t
  misc_feature (265)..(265): n is a, c, g, or t
  misc_feature (273)..(273): n is a, c, g, or t
  misc_feature (280)..(280): n is a, c, g, or t
  misc_feature (285)..(285): n is a, c, g, or t
  misc_feature (331)..(331): n is a, c, g, or t
  misc_feature (347)..(347): n is a, c, g, or t
cccgcgccgcgggggtgcccgctgaacgcgccgtccagctgcagctgcagtcgctctagagatcccgaggcgtccgaatggcattggtgctactttggacgtaagacttctcgggaactgaagattgcaggagccattggtccatgcgtatctctgaatgtgaaaggaccgtgtgtgtcagaaaatgagcttggtgttggtggcacgagtcagtggaaaatctgtggcctagatccnacatctacactnggcatctannnngaanttgtcaancagcacnacacnccgatcccccaaggaggcagaggagccatccagtttgtcacgcatnatcagcactccagcanatttctgcagcctgttcacaagattgatatgaacctcactgatcttcttggggagctacagagggacccatggccagtaactcaggggaagagacctttgcgatccactggtgtggctttgtccattgctgttggcttgctggagggcacttttccaaacacaggagccaggatcatgctgtttactggaggtccccctacccaagggcctggcatggtggttggagatgaattaaagattcctattcgttcttggcatgatattgagaaagataatgcacgattcatgaaaaaggcaaccaagcactatgagatgcttgctaatcgaacagctgcaaatggtcactgcattgatatttatgcttgtgcccttgatcaaactggacttttggagatgaagtgttgtgcaaatcttactggaggctacatggtaatgggagattctttcaacacttctctcttcaagcagacattccaaagaatctttactaaagattttaatggagatttccgaatggcatttggtgctactttggacgtaaagacctctcgggaactgaagattgcaggagccattggtccatgcgtatctctgaatgtgaaaggaccgtgtgtgtcagaaaatgagcttggtgttggtggcacgagtcagtggaaaatctgtggcctagatcctacatctacacttggcatctattttgaagttgtcaatcagcacaacaccccgatcccccaaggaggcagaggagccatccagtttgtcacgcattatcagcactccagcacccagagacgcatccgcgtgaccaccatcgcccgaaattgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactgtgtcaaaagtttggacagtataacaaagaagaccccacttcttttaggttatcagattccttttctctatatcctcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagagccagtactcttggatagcagcagcattctagctgacagaattttgctgatggatactttctttcaaattgtcatttatcttggtgagaccatagcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagtcaggctcgattccttttgtccaaagtgaacccatctcagacacacaataacctgtatgcttggggacaggaaactggagcacccatcctaactgatgatgttagcctgcaggtgttcatggaccatttgaagaagctggctgtctccagtgcctgttaagctgaggatacaaccaggaaatgcaacggtgtcagattgtgttcaaaatgtctagaaaggcttgataacattcctgttacttttctagcagattttaacaaataatcaaggacattttatatgtaactctttagattataatttatttgtattcctgtctttgtcctttttcttgcactataaaattataaggtcataaatgttttggtacttgtagatgtttatgtgctttttgtatcctaacttttagaatctaaataaaatcagaggtaatgtattttggcagcttgtttaggtgagaatcttaatgatcataaaaggaaataaatctagatgcagaaagtactggctaaaatattgctaatacaaatgtgatttcctga

SEQ ID NO: 307949 - DNA, 3001 bp, Homo sapiens
aatgccttcttccggcagccttagtttcttccaaccagtgcagctccctgttccgcgagcatacgtcatcgttctcgctttccggtagctaaggcgatcagcgggacttcccactgagacgagcggatgtcatattgtatcagggcgaacctctgaggagcgctggctgcgcttaggcaacggtgcggcaggcgccggggttttctgaaacagaaacgtttaggggtggggaaacgtgttccgaggaactctcgttttgaagtgcgagatacacctgtcttgccctgttccaagatggtggcagagcttctctgagtctctcgcttcctccagtccgtcggagaagcgctctttgattggccagtggacagcgccgtggcatgacgcgctggggcgctggccaatcggttgagagctgagctggacttggcggtgggagccggagcctgcttgttgcagctgtgggtgaggacggctctagctagttcccttttagactatggcgacatacctggagttcatccagcagaatgaagaacgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttgtcaggttgattatcgagcaaaactttgggcctgtaatttctgttttcaaagaaatcagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcagatttctgcagcctgttcacaagattgatatgaacctcactgatcttcttggggagctacagagggacccatggccagtaactcaggggaagagacctttgcgatccactggtgtggctttgtccattgctgttggcttgctggagggcacttttccaaacacaggagccaggatcatgctgtttactggaggtccccctacccaagggcctggcatggtggttggagatgaattaaagattcctattcgttcttggcatgatattgagaaagataatgcacgattcatgaaaaaggcaaccaagcactatgagatgcttgctaatcgaacagctgcaaatggtcactgcattgatatttatgcttgtgcccttgatcaaactggacttttggagatgaagtgttgtgcaaatcttactggaggctacatggtaatgggagattctttcaacacttctctcttcaagcagacattccaaagaatctttactaaagattttaatggagatttccgaatggcatttggtgctactttggacgtaaagacctctcgggaactgaagattgcaggagccattggtccatgcgtatctctgaatgtgaaaggaccgtgtgtgtcagaaaatgagcttggtgttggtggcacgagtcagtggaaaatctgtggcctagatcctacatctacacttggcatctattttgaagttgtcaatcagcacaacaccccgatcccccaaggaggcagaggagccatccagtttgtcacgcattatcagcactccagcacccagagacgcatccgcgtgaccaccatcgcccgaaattgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactgtgtcaaaagtttggacagtataacaaagaagaccccacttcttttaggttatcagattccttttctctatatcctcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagagccagtactcttggatagcagcagcattctagctgacagaattttgctgatggatactttctttcaaattgtcatttatcttggtgagaccatagcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagtcaggctcgattccttttgtccaaagtgaacccatctcagacacacaataacctgtatgcttggggacaggaaactggagcacccatcctaactgatgatgttagcctgcaggtgttcatggaccatttgaagaagctggctgtctccagtgcctgttaagctgaggatacaaccaggaaatgcaacggtgtcagattgtgttcaaaatgtctagaaaggcttgataacattcctgttacttttctagcagattttaacaaataatcaaggacattttatatgtaactctttagattataatttatttgtattcctgtctttgtcctttttcttgcactataaaattataaggtcata

SEQ ID NO: 307950 - DNA, 1756 bp, Homo sapiens
  misc_feature (237)..(237): n is a, c, g, or t
  misc_feature (249)..(249): n is a, c, g, or t
  misc_feature (258)..(261): n is a, c, g, or t
  misc_feature (265)..(265): n is a, c, g, or t
  misc_feature (273)..(273): n is a, c, g, or t
  misc_feature (280)..(280): n is a, c, g, or t
  misc_feature (285)..(285): n is a, c, g, or t
  misc_feature (331)..(331): n is a, c, g, or t
  misc_feature (347)..(347): n is a, c, g, or t
cccgcgccgcgggggtgcccgctgaacgcgccgtccagctgcagctgcagtcgctctagagatcccgaggcgtccgaatggcattggtgctactttggacgtaagacttctcgggaactgaagattgcaggagccattggtccatgcgtatctctgaatgtgaaaggaccgtgtgtgtcagaaaatgagcttggtgttggtggcacgagtcagtggaaaatctgtggcctagatccnacatctacactnggcatctannnngaanttgtcaancagcacnacacnccgatcccccaaggaggcagaggagccatccagtttgtcacgcatnatcagcactccagcanccagagacgcatccgcgtgaccaccatcgcccgaaagagcttggtgttggtggcacgagtcagtggaaaatctgtggcctagatcctacatctacacttggcatctattttgaagttgtcaatcagcacaacaccccgatcccccaaggaggcagaggagccatccagtttgtcacgcattatcagcactccagcacccagagacgcatccgcgtgaccaccatcgcccgaaattgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactgtgtcaaaagtttggacagtataacaaagaagaccccacttcttttaggttatcagattccttttctctatatcctcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagagccagtactcttggatagcagcagcattctagctgacagaattttgctgatggatactttctttcaaattgtcatttatcttggtgagaccatagcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagtcaggctcgattccttttgtccaaagtgaacccatctcagacacacaataacctgtatgcttggggacaggaaactggagcacccatcctaactgatgatgttagcctgcaggtgttcatggaccatttgaagaagctggctgtctccagtgcctgttaagctgaggatacaaccaggaaatgcaacggtgtcagattgtgttcaaaatgtctagaaaggcttgataacattcctgttacttttctagcagattttaacaaataatcaaggacattttatatgtaactctttagattataatttatttgtattcctgtctttgtcctttttcttgcactataaaattataaggtcataaatgttttggtacttgtagatgtttatgtgctttttgtatcctaacttttagaatctaaataaaatcagaggtaatgtattttggcagcttgtttaggtgagaatcttaatgatcataaaaggaaataaatctagatgcagaaagtactggctaaaatattgctaatacaaatgtgatttcctga

SEQ ID NO: 307951 - DNA, 2388 bp, Homo sapiens
gcaagcacagacgcgcgacacaagggatgtagacgtgcgtcgccgggttgtaatttcatcacgagagctgagctggacttggcggtgggagccggagcctgcttgttgcagctgtgggtgaggacggctctagctaggtgagcggctccggccagttcccttttagactatggcgacatacctggagttcatccagcagaatgaagaacgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttgtcaggttgattatcgagcaaaactttgggcctgtaatttctgttttcaaagaaatcagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcagatttctgcagcctgttcacaagattgatatgaacctcactgatcttcttggggagctacagagggacccatggccagtaactcaggggaagagacctttgcgatccactggtgtggctttgtccattgctgttggcttgctggagggcacttttccaaacacaggagccaggatcatgctgtttactggaggtccccctacccaagggcctggcatggtggttggagatgaattaaagattcctattcgttcttggcatgatattgagaaagataatgcacgattcatgaaaaaggcaaccaagcactatgagatgcttgctaatcgaacagctgcaaatggtcactgcattgatatttatgcttgtgcccttgatcaaactggacttttggagatgaagtgttgtgcaaatcttactggaggctacatggtaatgggagattctttcaacacttctctcttcaagcagacattccaaagaatctttactaaagattttaatggagatttccgaatggcatttggtgctactttggacgtaaagacctctcgggaactgaagattgcaggagccattggtccatgcgtatctctgaatgtgaaaggaccgtgtgtgtcagaaaatgagcttggtgttggtggcacgagtcagtggaaaatctgtggcctagatcctacatctacacttggcatctattttgaagttgtcaatcagcacaacaccccgatcccccaaggaggcagaggagccatccagtttgtcacgcattatcagcactccagcacccagagacgcatccgcgtgaccaccatcgcccgaaattgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactgtgtcaaaagtttggacagtataacaaagaagaccccacttcttttaggttatcagattccttttctctatatcctcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagagccagtactcttggatagcagcagcattctagctgacagaattttgctgatggatactttctttcaaattgtcatttatcttggtgagaccatagcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagtcagcttcttcaaatggtccatgaacacctgcaggctaacatcatcagttaggagtcgacgcggccgcgaattta

SEQ ID NO: 307952 - DNA, 1073 bp, Homo sapiens
cgagttgatcccccttcgacggtgtcctggacctgacaactcatccgactgtgtcaaaagtttggacagtataacaaagaagaccccacttcttttaggttatcagattccttttctctatatcctcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagagccagtactcttggatagcagcagcattctagctgacagaattttgctgatggatactttctttcaaattgtcatttatcttggtgagaccatagcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagtcaggctcgattccttttgtccaaagtgaacccatctcagacacacaataacctgtatgcttggggacaggaaactggagcacccatcctaactgatgatgttagcctgcaggtgttcatggaccatttgaagaagctggctgtctccagtgcctgttaagctgaggatacaaccaggaaatgcaacggtgtcagattgtgttcaaaatgtctagaaaggcttgataacattcctgttacttttctagcagattttaacaaataatcaaggacattttatatgtaactctttagattataatttatttgtattcctgtctttgtcctttttcttgcactataaaattataaggtcataaatgttttggtacttgtagatgtttatgtgctttttgtatcctaacttttagaatctaaataaaatcagaggtaatgtattttggcagcttgtttaggtgagaatcttaatgatcataaaaggaaataaatctagatgcagaaagtactggctaaaatattgctaatacaaatgtgatttcctga

SEQ ID NO: 307953 - DNA, 1289 bp, Homo sapiens
  misc_feature (1185)..(1185): n is a, c, g, or t
  misc_feature (1199)..(1199): n is a, c, g, or t
  misc_feature (1212)..(1212): n is a, c, g, or t
  misc_feature (1243)..(1243): n is a, c, g, or t
  misc_feature (1253)..(1253): n is a, c, g, or t
  misc_feature (1289)..(1289): n is a, c, g, or t
gcaagcacagacgcgcgacacaagggatgtagacgtgcgtcgccgggttgtaatttcatcacgagagctgagctggacttggcggtgggagccggagcctgcttgttgcagctgtgggtgaggacggctctagctaggtgagcggctccggccagttcccttttagactatggcgacatacctggagttcatccagcagaatgaagaacgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttgtcaggttgattatcgagcaaaactttgggcctgtaatttctgttttcaaagaaatcagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcagatttctgcagcctgttcacaagattgatatgaacctcactgatcttcttggggagctacagagggacccatggccagtaactcaggggaagagacctttgcgatccactggtgtggctttgtccattgctgttggcttgctggagggcacttttccaaacacaggagccaggatcatgctgtttactggaggtccccctacccaagggcctggcatggtggttggagatgaattaaagattcctattcgttcttggcatgatattgagaaagataatgcacgattcatgaaaaaggcaaccaaggcactatgaagatggctttgccnaatccgaacaagcntgcaaaatggggnccactggcattggatattttaaggccttggngccctttggnttcaaaactgggaccttttttggggagaattaaagn

SEQ ID NO: 307954 - DNA, 1279 bp, Homo sapiens
gcaagcacagacgcgcgacacaagggatgtagacgtgcgtcgccgggttgtaatttcatcacgagagctgagctggacttggcggtgggagccggagcctgcttgttgcagctgtgggtgaggacggctctagctaggtgagcggctccggccagttcccttttagactatggcgacatacctggagttcatccagcagaatgaagaacgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttgtcaggttgattatcgagcaaaactttgggcctgtaatttctgttttcaaagaaatcagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcagatttctgcagcctgttcacaagattgatatgaacctcactgatcttcttggggagctacagagggacccatggccagtaactcaggggaagagacctttgcgatccactggtgtggctttgtccattgctgttggcttgctggagggcacttttccaaacacaggagccaggatcatgctgtttactggaggtccccctacccaagggcctggcatggtggttggagatgaattaaagattcctattcgttcttggcatgatattgagaaagataatgcacgattcatgaaaaaggcaaccaagcactctgtgatgctttctaatcgcgcacatgtccaaatgtacaccacatttatatatgcgcgtgccccgtatcacacacgtgtcttggagatgagtgtgtgcacaattactcttggc

SEQ ID NO: 307955 - DNA, 1382 bp, Homo sapiens
  misc_feature (237)..(237): n is a, c, g, or t
  misc_feature (249)..(249): n is a, c, g, or t
  misc_feature (258)..(261): n is a, c, g, or t
  misc_feature (265)..(265): n is a, c, g, or t
  misc_feature (273)..(273): n is a, c, g, or t
  misc_feature (280)..(280): n is a, c, g, or t
  misc_feature (285)..(285): n is a, c, g, or t
  misc_feature (331)..(331): n is a, c, g, or t
  misc_feature (347)..(347): n is a, c, g, or t
cccgcgccgcgggggtgcccgctgaacgcgccgtccagctgcagctgcagtcgctctagagatcccgaggcgtccgaatggcattggtgctactttggacgtaagacttctcgggaactgaagattgcaggagccattggtccatgcgtatctctgaatgtgaaaggaccgtgtgtgtcagaaaatgagcttggtgttggtggcacgagtcagtggaaaatctgtggcctagatccnacatctacactnggcatctannnngaanttgtcaancagcacnacacnccgatcccccaaggaggcagaggagccatccagtttgtcacgcatnatcagcactccagcanccagagacgcatccgcgtgaccaccatcgcccgaaattgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactgtgtcaaaagtttggacagtataacaaagaagaccccacttcttttaggttatcagattccttttctctatatcctcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagagcaagaaattctgcaagcacgcttcccgatgccacgttacatcaacacggagcatggaggcagtcaggctcgattccttttgtccaaagtgaacccatctcagacacacaataacctgtatgcttggggacaggaaactggagcacccatcctaactgatgatgttagcctgcaggtgttcatggaccatttgaagaagctggctgtctccagtgcctgttaagctgaggatacaaccaggaaatgcaacggtgtcagattgtgttcaaaatgtctagaaaggcttgataacattcctgttacttttctagcagattttaacaaataatcaaggacattttatatgtaactctttagattataatttatttgtattcctgtctttgtcctttttcttgcactataaaattataaggtcataaatgttttggtacttgtagatgtttatgtgctttttgtatcctaacttttagaatctaaataaaatcagaggtaatgtattttggcagcttgtttaggtgagaatcttaatgatcataaaaggaaataaatctagatgcagaaagtactggctaaaatattgctaatacaaatgtgatttcctga

SEQ ID NO: 307956 - DNA, 962 bp, Homo sapiens
gcaagcacagacgcgcgacacaagggatgtagacgtgcgtcgccgggttgtaatttcatcacgagagctgagctggacttggcggtgggagccggagcctgcttgttgcagctgtgggtgaggacggctctagctaggtgagcggctccggccagttcccttttagactatggcgacatacctggagttcatccagcagaatgaagaacgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttgtcaggttgattatcgagcaaaactttgggcctgtaatttctgttttcaaagaaatcagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcaggactttacacacctgtgtaaaaggatgtgggagaggagggtctgaagctgatctgctaaatgaatatccctgctctgctggtcaataaaacgcttcctaatagc

SEQ ID NO: 307957 - DNA, 1334 bp, Homo sapiens
tgtttaactacatgtagtttggagatgatcaggtgattgtaaacctcccactcctttgatttatttttaagtgcttgaaaggagaggtgagaaaggagcagtgatcaatgataactgtgcggttaactgacttttgggtatcagatggaaaagaaatactgtcattctacagcaacaggttcttcccaagtatttaagaaacactgtgttagttgggccgggtacagtgggtcacgcctgtaatcccagcactttggaaggccaaggcgggtggatcacctgaggtcaggagtttgagaccagcctggccaacatggtgaaaccctgcctctactaaaaatacaaaaaattagccgggcttggtggcacaggcttgtaatcccagctacttgggaggctgtggcaggagaatcgcttgaacccgggaggtggaggctgcagtgagctgagatgggaaaaaaagagaaacactgtgttacatgacccatcttctttttttgacatttagttcagaatttcacataccattaaggtaattaaagttttatcttcagttcccttttagactatggcgacatacctggagttcatccagcagaatgaagaacgggatggtgtgcgttttagttggaacgtgtggccttccagccggctggaggatacaaccaggaaatgcaacggtgtcagattgtgttcaaaatgtctagaaaggcttgataacattcctgttacttttctagcagattttaacaaataatcaaggacattttatatgtaactctttagattataatttatttgtattcctgtctttgtcctttttcttgcactataaaattataaggtcataaatgttttggtacttgtagatgtttatgtgctttttgtatcctaacttttagaatctaaataaaatcagaggtaatgtattttggcagcttgtttaggtgagaatcttaatgatcataaaaggaaataaatctagatgcagaaagtactggctaaaatattgctaatacaaatgtgatttcctgaggtctctgtgtgagtgtgtatgtgttttaagtgacttccttaagaggtgtttcctgaacctaattctcataattaaagtaatgtatatgcaggatcaaaatgaaacaaatataccttatcctaaagagctcataacaaataagttacctccactctataaactcagacctactttttgaagataactgcttttaacctctccttacaagatttttgttgttgatgtatttaattttagcccatgtctcaattctcattttcaaagaatcaatatattaatatacctttggtcaaatttg

SEQ ID NO: 307958 - DNA, 1113 bp, Homo sapiens
aatgccttcttccggcagccttagtttcttccaaccagtgcagctccctgttccgcgagcatacgtcatcgttctcgctttccggtagctaaggcgatcagcgggacttcccactgagacgagcggatgtcatattgtatcagggcgaacctctgaggagcgctggctgcgcttaggcaacggtgcggcaggcgccggggttttctgaaacagaaacgtttaggggtggggaaacgtgttccgaggaactctcgttttgaagtgcgagatacacctgtcttgccctgttccaagatggtggcagagcttctctgagtctctcgcttcctccagtccgtcggagaagcgctctttgattggccagtggacagcgccgtggcatgacgcgctggggcgctggccaatcggttgagagctgagctggacttggcggtgggagccggagcctgcttgttgcagctgtgggtgaggacggctctagctagttcccttttagactatggcgacatacctggagttcatccagcagaatgaagaacgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttgtcaggttgattatcgagcaaaactttgggcctgtaatttctgttttcaaagaaatcagtttcctccagcttatggaggcatatctgaggtgaatcaacctgccgaattgatgccccagttttctacaattgagtacgtgatacaggtaatttctttgttgtgcatttaatgagcaatgttaaatactgaatttctcttgaaatcctttgtcttccatgtctcttacctgggcaggggacttaaagctgtgagggcagcaggatcctaacctttaggtttgatgtgtgtgcatctactggcattgttttcaagtcctgacattatagaaggctactaaaaaggtagaactgattaaattccaaacctgttctctgtagccttcttcatctcagt

SEQ ID NO: 307959 - DNA, 5344 bp, Homo sapiens
tttattgaacatttattctgttcaaaacattcccaaaggcaacagaagatacaaataaatctctgcccatgaaaaggtgtggggggcattagaaggcgttctcttcggtgtaatgaagtaatgagagaagaaaaagtagtttgaagctatggagtaagggactttgagtatcccaggctcaaaaagttgggacttgaacagtacgggggtgctgctgaaaacgtttgagggaggtaatgacatgatcgaagctatacttgagaaaggtgaatctgataaagtatgagtgaaaaagagactgaaggtctagaaattagattgaggctaatgacaaaatccacataaataggaggacttgaacgaaggggcacttagaagaggacaggagatagtaaaaggcattcaatgatgagagcacacactacaggggagcatgagggaggttggaaaagataatgaaaggattaccgagcttcactgacgatgtgtttgaaatgagcaggaatcttgtagtgatcctaatccgtggttttctggagcatttcacagcctaggaacatacaaggggggcatctccctggaatgtaaattgactaagaggaattcaataatggtcaaatgaatgcagaattttagagtcttgcttagtattctcaccacatttcgtttagtctactcatactctttttctcttactgctgacactagatggaaaaactcttaattaaaagtatttcacaaaatgtgctcgttttcagtcattccgtttccactccagcctgttgtgttgtttttttgaaataataatttaaagtaattttccttttgcaggatggcatagtcaatccaacaataagaaaagatttgaaaactggaccgaaattctactgctgtccaattgaaggctgccccagaggccctgagagaccgttttctcagttttctctcgtaaaacagcactttatgaaaatgcatgctgagaagaagcacaaatgtagtaagtgcagcaattcgtacggtacagaatgggacctgaaaagacatgcagaggactgtggcaagaccttccggtgcacatgcggctgtccctacgccagtagaacagcactgcagtctcacatctaccgaactgggcacgagatacctgcagaacacagggacccacctagtaagaaaaggaaaatggaaaactgtgcacaaaaccagaagttatccaacaagaccattgaatcattgaacaaccaaccaatccctagaccagacactcaagaactagaagcttcagaaataaagctagaaccatcttttgaagactcttgtggctctaacactgacaagcagactcttacaacaccaccgagatatcctcagaagttgcttttaccaaagcccaaagtggctttggttaaactacccgtgatgcagttttctgtcatgcctgtctttgtgcctacagccgactcctcagcccagcctgtggtgttaggtgttgatcagggctctgccacaggggctgtgcacttaatgcccttgtcagtaggaaccctgatcctcggcctagattcagaggcttgctctcttaaggagagcctacctcttttcaaaattgctaatcctattgctggtgagccaataagtactggtgttcaagtgaactttggtaaaagtccatctaatcctttacaagaactagggaacacgtgtcaaaagaatagcatttcttcaatcaacgtgcagacagatctgtcttatgcctcacaaaactttataccttctgcacagtgggccactgctgattcctctgtgtcgtcttgttctcaaactgatttgtcgtttgattctcaagtgtctcttcccattagtgttcacactcagacatttttgcccagctctaaggtaacttcatctatagctgctcagactgatgcatttatggacacctgtttccagtcaggtggggtctccagagaaactcaaaccagtgggatagaaagtccaacggatgaccatgtacagatggaccaagctggaatgtgcggagacatttttgagagtgttcattcatcatataatgttgctacaggtaacattataagcaacagtttagtagcagagacagtaactcatagtttgttacctcagaatgagcctaagactttaaatcaagatattgagaaatctgcaccaattataaatttcagtgcacagaatagtatgcttccttcacagaacatgacagataatcagacccaaaccatagatttattaagtgatttggaaaacatcttgtcaagtaatctgcctgcccagacattggatcatcgtagtcttttgtctgacacaaatcctggacctgacacccagctcccatctggcccagcccagaaccccggaatcgattttgatatcgaagagttcttttcggcctcaaatatccagactcaaactgaagagagtgaacttagcaccatgaccaccgagccagtcttggagtcactggacatagagactcaaacggacttcttactcgcagatacctctgctcagtcctatgggtgtaggggaaattctaacttcttaggccttgagatgtttgacacacagacacagacagacttaaactttttcttagacagtagccctcatctgcctctgggaagtattctgaaacactccagcttttccgtgagtactgattcatctgacacagagacccaaactgaaggagtctccactgctaaaaatatacctgctctagaaagcaaagttcagttgaacagtacagaaacacagaccatgagttctgggtttgaaaccctggggagcttgttcttcaccagcaacgaaactcagacagcaatggatgactttcttctggctgatctggcctggaacacgatggagtctcagttcagctctgtagaaacccagacttctgcggaaccacacacagtctccaacttctaaaactaacggtggagtccatgtgtgaaatggcatctaccatttcctctggattaaaactacggactggggacaacagtattaattcgattgaatgtggctgatgatgcagttgcttagcttctttgtgtttctttgccttttgtacttgtaaacagaaatttgcgtataaatgtgagtgtattataaagtttgagatgttgatctaaattgtttttgtgttgcctacatttgccttttcacagctagtcttttcatgttaaaaaaaaaatgtatttcatatctataaaacctatatagccatttagctgaagcccagcttaccaggttcaagggtacaaacttctcaaatcttcaaaacattttagtcaaagtgtaatatacttaaactgcacctaaaatatctttggcactgcttgttagaaattcctgattcctgttactaatcactaaagaaaccggatgctgccaccgtaggatttaagcagtagtgcttccatgctcttaagactcctgctgcctggaccttcgtcagctttgacacctcttttctgatttaaagacaccaaggaaaactacaactgtctttagctttgaagcagttttcatgtaatcattgccacctcttcgctacatgaactactattgataccagcatacaagtgtatagcactttacacacaagaggtttattgatgtaaaattatcggctagggaagcagcagcgggccaggtgtggtggcttacccctgtaatcccagcactttgggaggccaaagcaggacgatcacttgagcccaggagttcaacaccagcttgggcaacataagaagaccgtgtctctggaatttttttttttttttaattagccaggcacagtggcatgcgcctgtgatcccagctacttggaaggctgaggtgagaggatcactcgaggagattggggctgccatgagccatggtcttggcactgtactccaacctgggtaacagggcaagaccctatctcaaaaaaaaaaaaaaagtcgccagcaacaagcacgtagtgtagtgttcctgctaaatgagcataggttatccaaaccttgggaacagggagttatggaaacgtgcctatgacttcatcttggggtgtgtcctatgaagatcctttctggtctccacagtaggccagagttgggggctctggagctgtttccccaagtgcatccacaagctggatctgagttttgtcactctaaaattaaacaagaaaaaaagtgggaaaagggcatcccccattaggtttcaatactttgcacttctactaagcttgatagggcaggagtgcaatctacaattattttaaagtgaatttccttccattcaccattctttatcttttctttgaataagaaaaagtatctagcaaggatattacttgtgccttgaggctagcaattataggatagattcatctaaaatatggtattctgcattttggttttttttcttaagtgaataataccagtcttcaaagaaaacaaggtgaagacctattgcttcaataatcaagaatgctttgtgtgttttgaggtaggagcatgatcaagtatgctttggggattttctgtatttaggagatcctggattcttaattgttggctaagttccagtcaagtaggaatcagtgcagcctgtaagttctccacattgacacacacacacacacacacacacacacacacgacatgctcctttctgtggcacatgcctgtattactgaaagctaaatcctcaaaacctagtaaggggaccaatgattcattaaagtaaattgatggttttgctactaattcctatcccatacatttgacacaaaagaagtgttggtaatggataaataacatatcccgggcagatgagctcaacctagtaggtaagagtttggtttggtcacagttgcctatgagtgtgggtttcaaaagaaacataaagccttaacttagaatttcattatgttttagaatcatcactgccttaatattcaagcatctatttaagtcctaataaaggagaaatgcatgtttatggcttttttgtaaatataaatgcagtgatctatggcttaaaaaatttgtttctgtgacaatgtttgtaaatctagccaatagagtcatttacagaagaaaaatgagcatgtaataatacaagaactgtttccccctcaaaacctgaacctgaattatttgtaaaaactgaaatttaatgattaaagagaagccagaattgtacccttttttgtgaattcttgaacgtactcataaatatgacttattgtattgccttaagttttcactcattgtcttttgaaagccatatgataaaatgattttattta

SEQ ID NO: 307960 - DNA, 728 bp, Homo sapiens
acgagctgggccgggcggccgtgcgggagccatggcggcctcggaggcggcggcggcggcggggtccgcggctctggcggcgggtgcccgggccgtcccggcggccacgacaggagccgccgccgccgcctcgggcccgtgggtgcccccgggaccccgactgaggggcagccggccgcggcccgcgggggcgacgcagcagcccgctgtccccgcgccgccggcgggggagctgatccagccgtcggtgagcgagctgtcccgggccgtgcggaccaacatcctgtgcaccgtgcgcggctgcggcaagatcctgcccaacagccccgcgctcaacatgcacctagtcaagagccaccgcctgcaggatggcatagtcaatccaacaataagaaaagatttgaaaactggaccgaaattctactgctgtccaattgaaggctgccccagaggccctgagagaccgttttctcagttttctctcgtaaaacaggtactctctactctgaggatgagatacagatgctaaaaacctattgtgcattctgattacttagcagacataactacagaattgagtagacagctgcttgtgaggggagatgcctgcgtgtctcccagttggtataaacctgagtatgctgttacacaagtggagggaaaagcggcacggtctggagggaatatgtctagaagtgagttaaaatacagagagagagagtaaacca

SEQ ID NO: 307961 - DNA, 428 bp, Homo sapiens
tttattgaacatttattctgttcaaaacattcccaaaggcaacagaagatacaaataaatctctgcccatgaaaaggtgtggggggcattagaaggcgttctcttcggtgtaatgaagtaatgagagaagaaaaagtagtttgaagctatggagtaagggactttgagtatcccaggctcaaaaagttgggacttgaacagtacgggggtgctgctgaaaacgtttgagggaggtaatgacatgatcgaagctatacttgagaaaggtgaatctgataaagtatgagtgaaaaagagactgaaggtctagaaattagattgaggctgaggcaggagaatcgcttgaacctgggaggcagaggttgcagtgagccaagcctgcaccactgtactccaccctggatggcaaagtgagactctgtctcaaa

SEQ ID NO: 307962 - DNA, 4901 bp, Homo sapiens
acgagctgggccgggcggccgtgcgggagccatggcggcctcggaggcggcggcggcggcggggtccgcggctctggcggcgggtgcccgggccgtcccggcggccacgacaggagccgccgccgccgcctcgggcccgtgggtgcccccgggaccccgactgaggggcagccggccgcggcccgcgggggcgacgcagcagcccgctgtccccgcgccgccggcgggggagctgatccagccgtcggtgagcgagctgtcccgggccgtgcggaccaacatcctgtgcaccgtgcgcggctgcggcaagatcctgcccaacagccccgcgctcaacatgcacctagtcaagagccaccgcctgcaggatggcatagtcaatccaacaataagaaaagatttgaaaactggaccgaaattctactgctgtccaattgaaggctgccccagaggccctgagagaccgttttctcagttttctctcgtaaaacagtcccttctgcgttcctcctagcactttatgaaaatgcatgctgagaagaagcacaaatgtagtaagtgcagcaattcgtacggtacagaatgggacctgaaaagacatgcagaggactgtggcaagaccttccggtgcacatgcggctgtccctacgccagtagaacagcactgcagtctcacatctaccgaactgggcacgagatacctgcagaacacagggacccacctagtaagaaaaggaaaatggaaaactgtgcacaaaaccagaagttatccaacaagaccattgaatcattgaacaaccaaccaatccctagaccagacactcaagaactagaagcttcagaaataaagctagaaccatcttttgaagactcttgtggctctaacactgacaagcagactcttacaacaccaccgagatatcctcagaagttgcttttaccaaagcccaaagtggctttggttaaactacccgtgatgcagttttctgtcatgcctgtctttgtgcctacagccgactcctcagcccagcctgtggtgttaggtgttgatcagggctctgccacaggggctgtgcacttaatgcccttgtcagtaggaaccctgatcctcggcctagattcagaggcttgctctcttaaggagagcctacctcttttcaaaattgctaatcctattgctggtgagccaataagtactggtgttcaagtgaactttggtaaaagtccatctaatcctttacaagaactagggaacacgtgtcaaaagaatagcatttcttcaatcaacgtgcagacagatctgtcttatgcctcacaaaactttataccttctgcacagtgggccactgctgattcctctgtgtcgtcttgttctcaaactgatttgtcgtttgattctcaagtgtctcttcccattagtgttcacactcagacatttttgcccagctctaaggtaacttcatctatagctgctcagactgatgcatttatggacacctgtttccagtcaggtggggtctccagagaaactcaaaccagtgggatagaaagtccaacggatgaccatgtacagatggaccaagctggaatgtgcggagacatttttgagagtgttcattcatcatataatgttgctacaggtaacattataagcaacagtttagtagcagagacagtaactcatagtttgttacctcagaatgagcctaagactttaaatcaagatattgagaaatctgcaccaattataaatttcagtgcacagaatagtatgcttccttcacagaacatgacagataatcagacccaaaccatagatttattaagtgatttggaaaacatcttgtcaagtaatctgcctgcccagacattggatcatcgtagtcttttgtctgacacaaatcctggacctgacacccagctcccatctggcccagcccagaaccccggaatcgattttgatatcgaagagttcttttcggcctcaaatatccagactcaaactgaagagagtgaacttagcaccatgaccaccgagccagtcttggagtcactggacatagagactcaaacggacttcttactcgcagatacctctgctcagtcctatgggtgtaggggaaattctaacttcttaggccttgagatgtttgacacacagacacagacagacttaaactttttcttagacagtagccctcatctgcctctgggaagtattctgaaacactccagcttttccgtgagtactgattcatctgacacagagacccaaactgaaggagtctccactgctaaaaatatacctgctctagaaagcaaagttcagttgaacagtacagaaacacagaccatgagttctgggtttgaaaccctggggagcttgttcttcaccagcaacgaaactcagacagcaatggatgactttcttctggctgatctggcctggaacacgatggagtctcagttcagctctgtagaaacccagacttctgcggaaccacacacagtctccaacttctaaaactaacggtggagtccatgtgtgaaatggcatctaccatttcctctggattaaaactacggactggggacaacagtattaattcgattgaatgtggctgatgatgcagttgcttagcttctttgtgtttctttgccttttgtacttgtaaacagaaatttgcgtataaatgtgagtgtattataaagtttgagatgttgatctaaattgtttttgtgttgcctacatttgccttttcacagctagtcttttcatgttaaaaaaaaaatgtatttcatatctataaaacctatatagccatttagctgaagcccagcttaccaggttcaagggtacaaacttctcaaatcttcaaaacattttagtcaaagtgtaatatacttaaactgcacctaaaatatctttggcactgcttgttagaaattcctgattcctgttactaatcactaaagaaaccggatgctgccaccgtaggatttaagcagtagtgcttccatgctcttaagactcctgctgcctggaccttcgtcagctttgacacctcttttctgatttaaagacaccaaggaaaactacaactgtctttagctttgaagcagttttcatgtaatcattgccacctcttcgctacatgaactactattgataccagcatacaagtgtatagcactttacacacaagaggtttattgatgtaaaattatcggctagggaagcagcagcgggccaggtgtggtggcttacccctgtaatcccagcactttgggaggccaaagcaggacgatcacttgagcccaggagttcaacaccagcttgggcaacataagaagaccgtgtctctggaatttttttttttttttaattagccaggcacagtggcatgcgcctgtgatcccagctacttggaaggctgaggtgagaggatcactcgaggagattggggctgccatgagccatggtcttggcactgtactccaacctgggtaacagggcaagaccctatctcaaaaaaaaaaaaaaagtcgccagcaacaagcacgtagtgtagtgttcctgctaaatgagcataggttatccaaaccttgggaacagggagttatggaaacgtgcctatgacttcatcttggggtgtgtcctatgaagatcctttctggtctccacagtaggccagagttgggggctctggagctgtttccccaagtgcatccacaagctggatctgagttttgtcactctaaaattaaacaagaaaaaaagtgggaaaagggcatcccccattaggtttcaatactttgcacttctactaagcttgatagggcaggagtgcaatctacaattattttaaagtgaatttccttccattcaccattctttatcttttctttgaataagaaaaagtatctagcaaggatattacttgtgccttgaggctagcaattataggatagattcatctaaaatatggtattctgcattttggttttttttcttaagtgaataataccagtcttcaaagaaaacaaggtgaagacctattgcttcaataatcaagaatgctttgtgtgttttgaggtaggagcatgatcaagtatgctttggggattttctgtatttaggagatcctggattcttaattgttggctaagttccagtcaagtaggaatcagtgcagcctgtaagttctccacattgacacacacacacacacacacacacacacacacgacatgctcctttctgtggcacatgcctgtattactgaaagctaaatcctcaaaacctagtaaggggaccaatgattcattaaagtaaattgatggttttgctactaattcctatcccatacatttgacacaaaagaagtgttggtaatggataaataacatatcccgggcagatgagctcaacctagtaggtaagagtttggtttggtcacagttgcctatgagtgtgggtttcaaaagaaacataaagccttaacttagaatttcattatgttttagaatcatcactgccttaatattcaagcatctatttaagtcctaataaaggagaaatgcatgtttatggcttttttgtaaatataaatgcagtgatctatggcttaaaaaatttgtttctgtgacaatgtttgtaaatctagccaatagagtcatttacagaagaaaaatgagcatgtaataatacaagaactgtttccccctcaaaacctgaacctgaattatttgtaaaaactgaaatttaatgattaaagagaagccagaattgtacccttttttgtgaattcttgaacgtactcataaatatgacttattgtattgccttaagttttcactcattgtcttttgaaagccatatgataaaatgattttattta

SEQ ID NO: 307963 - DNA, 4597 bp, Homo sapiens
agcagtgacataattcaaaagcgcaagtcattgaaagcagttctgcgaatatgtagcttttgatgatcaggagtaaatttagagtacccagaatattgcatgttctgtctgcccatagtcaggcttctgataagaatttcacagcagaaaactctgaggttgtagtctctagtaggacagatgtgtcgccaatgaagagtgatctgctcttaccaccatctaaaccgggatgcaacaacgttctcaattgaagatcagggagccagtcaggaaatgtacctgaggatggcatagtcaatccaacaataagaaaagatttgaaaactggaccgaaattctactgctgtccaattgaaggctgccccagaggccctgagagaccgttttctcagttttctctcgtaaaacagggacccacctagtaagaaaaggaaaatggaaaactgtgcacaaaaccagaagttatccaacaagaccattgaatcattgaacaaccaaccaatccctagaccagacactcaagaactagaagcttcagaaataaagctagaaccatcttttgaagactcttgtggctctaacactgacaagcagactcttacaacaccaccgagatatcctcagaagttgcttttaccaaagcccaaagtggctttggttaaactacccgtgatgcagttttctgtcatgcctgtctttgtgcctacagccgactcctcagcccagcctgtggtgttaggtgttgatcagggctctgccacaggggctgtgcacttaatgcccttgtcagtaggaaccctgatcctcggcctagattcagaggcttgctctcttaaggagagcctacctcttttcaaaattgctaatcctattgctggtgagccaataagtactggtgttcaagtgaactttggtaaaagtccatctaatcctttacaagaactagggaacacgtgtcaaaagaatagcatttcttcaatcaacgtgcagacagatctgtcttatgcctcacaaaactttataccttctgcacagtgggccactgctgattcctctgtgtcgtcttgttctcaaactgatttgtcgtttgattctcaagtgtctcttcccattagtgttcacactcagacatttttgcccagctctaaggtaacttcatctatagctgctcagactgatgcatttatggacacctgtttccagtcaggtggggtctccagagaaactcaaaccagtgggatagaaagtccaacggatgaccatgtacagatggaccaagctggaatgtgcggagacatttttgagagtgttcattcatcatataatgttgctacaggtaacattataagcaacagtttagtagcagagacagtaactcatagtttgttacctcagaatgagcctaagactttaaatcaagatattgagaaatctgcaccaattataaatttcagtgcacagaatagtatgcttccttcacagaacatgacagataatcagacccaaaccatagatttattaagtgatttggaaaacatcttgtcaagtaatctgcctgcccagacattggatcatcgtagtcttttgtctgacacaaatcctggacctgacacccagctcccatctggcccagcccagaaccccggaatcgattttgatatcgaagagttcttttcggcctcaaatatccagactcaaactgaagagagtgaacttagcaccatgaccaccgagccagtcttggagtcactggacatagagactcaaacggacttcttactcgcagatacctctgctcagtcctatgggtgtaggggaaattctaacttcttaggccttgagatgtttgacacacagacacagacagacttaaactttttcttagacagtagccctcatctgcctctgggaagtattctgaaacactccagcttttccgtgagtactgattcatctgacacagagacccaaactgaaggagtctccactgctaaaaatatacctgctctagaaagcaaagttcagttgaacagtacagaaacacagaccatgagttctgggtttgaaaccctggggagcttgttcttcaccagcaacgaaactcagacagcaatggatgactttcttctggctgatctggcctggaacacgatggagtctcagttcagctctgtagaaacccagacttctgcggaaccacacacagtctccaacttctaaaactaacggtggagtccatgtgtgaaatggcatctaccatttcctctggattaaaactacggactggggacaacagtattaattcgattgaatgtggctgatgatgcagttgcttagcttctttgtgtttctttgccttttgtacttgtaaacagaaatttgcgtataaatgtgagtgtattataaagtttgagatgttgatctaaattgtttttgtgttgcctacatttgccttttcacagctagtcttttcatgttaaaaaaaaaatgtatttcatatctataaaacctatatagccatttagctgaagcccagcttaccaggttcaagggtacaaacttctcaaatcttcaaaacattttagtcaaagtgtaatatacttaaactgcacctaaaatatctttggcactgcttgttagaaattcctgattcctgttactaatcactaaagaaaccggatgctgccaccgtaggatttaagcagtagtgcttccatgctcttaagactcctgctgcctggaccttcgtcagctttgacacctcttttctgatttaaagacaccaaggaaaactacaactgtctttagctttgaagcagttttcatgtaatcattgccacctcttcgctacatgaactactattgataccagcatacaagtgtatagcactttacacacaagaggtttattgatgtaaaattatcggctagggaagcagcagcgggccaggtgtggtggcttacccctgtaatcccagcactttgggaggccaaagcaggacgatcacttgagcccaggagttcaacaccagcttgggcaacataagaagaccgtgtctctggaatttttttttttttttaattagccaggcacagtggcatgcgcctgtgatcccagctacttggaaggctgaggtgagaggatcactcgaggagattggggctgccatgagccatggtcttggcactgtactccaacctgggtaacagggcaagaccctatctcaaaaaaaaaaaaaaagtcgccagcaacaagcacgtagtgtagtgttcctgctaaatgagcataggttatccaaaccttgggaacagggagttatggaaacgtgcctatgacttcatcttggggtgtgtcctatgaagatcctttctggtctccacagtaggccagagttgggggctctggagctgtttccccaagtgcatccacaagctggatctgagttttgtcactctaaaattaaacaagaaaaaaagtgggaaaagggcatcccccattaggtttcaatactttgcacttctactaagcttgatagggcaggagtgcaatctacaattattttaaagtgaatttccttccattcaccattctttatcttttctttgaataagaaaaagtatctagcaaggatattacttgtgccttgaggctagcaattataggatagattcatctaaaatatggtattctgcattttggttttttttcttaagtgaataataccagtcttcaaagaaaacaaggtgaagacctattgcttcaataatcaagaatgctttgtgtgttttgaggtaggagcatgatcaagtatgctttggggattttctgtatttaggagatcctggattcttaattgttggctaagttccagtcaagtaggaatcagtgcagcctgtaagttctccacattgacacacacacacacacacacacacacacacacgacatgctcctttctgtggcacatgcctgtattactgaaagctaaatcctcaaaacctagtaaggggaccaatgattcattaaagtaaattgatggttttgctactaattcctatcccatacatttgacacaaaagaagtgttggtaatggataaataacatatcccgggcagatgagctcaacctagtaggtaagagtttggtttggtcacagttgcctatgagtgtgggtttcaaaagaaacataaagccttaacttagaatttcattatgttttagaatcatcactgccttaatattcaagcatctatttaagtcctaataaaggagaaatgcatgtttatggcttttttgtaaatataaatgcagtgatctatggcttaaaaaatttgtttctgtgacaatgtttgtaaatctagccaatagagtcatttacagaagaaaaatgagcatgtaataatacaagaactgtttccccctcaaaacctgaacctgaattatttgtaaaaactgaaatttaatgattaaagagaagccagaattgtacccttttttgtgaattcttgaacgtactcataaatatgacttattgtattgccttaagttttcactcattgtcttttgaaagccatatgataaaatgattttattta

SEQ ID NO: 307964 - DNA, 1723 bp, Homo sapiens
aagaggtttattgatgtaaagtgctatacacttgtatgctggtatcaatagtagttcatgtagcgaagaggtggcaatgattacatgaaaactgcttcaaagctaaagacagttgtatagcactttacacacaagaggtttattgatgtaaaattatcggctagggaagcagcagcgggccaggtgtggtggcttacccctgtaatcccagcactttgggaggccaaagcaggacgatcacttgagcccaggagttcaacaccagcttgggcaacataagaagaccgtgtctctggaatttttttttttttttaattagccaggcacagtggcatgcgcctgtgatcccagctacttggaaggctgaggtgagaggatcactcgaggagattggggctgccatgagccatggtcttggcactgtactccaacctgggtaacagggcaagaccctatctcaaaaaaaaaaaaaaagtcgccagcaacaagcacgtagtgtagtgttcctgctaaatgagcataggttatccaaaccttgggaacagggagttatggaaacgtgcctatgacttcatcttggggtgtgtcctatgaagatcctttctggtctccacagtaggccagagttgggggctctggagctgtttccccaagtgcatccacaagctggatctgagttttgtcactctaaaattaaacaagaaaaaaagtgggaaaagggcatcccccattaggtttcaatactttgcacttctactaagcttgatagggcaggagtgcaatctacaattattttaaagtgaatttccttccattcaccattctttatcttttctttgaataagaaaaagtatctagcaaggatattacttgtgccttgaggctagcaattataggatagattcatctaaaatatggtattctgcattttggttttttttcttaagtgaataataccagtcttcaaagaaaacaaggtgaagacctattgcttcaataatcaagaatgctttgtgtgttttgaggtaggagcatgatcaagtatgctttggggattttctgtatttaggagatcctggattcttaattgttggctaagttccagtcaagtaggaatcagtgcagcctgtaagttctccacattgacacacacacacacacacacacacacacacacgacatgctcctttctgtggcacatgcctgtattactgaaagctaaatcctcaaaacctagtaaggggaccaatgattcattaaagtaaattgatggttttgctactaattcctatcccatacatttgacacaaaagaagtgttggtaatggataaataacatatcccgggcagatgagctcaacctagtaggtaagagtttggtttggtcacagttgcctatgagtgtgggtttcaaaagaaacataaagccttaacttagaatttcattatgttttagaatcatcactgccttaatattcaagcatctatttaagtcctaataaaggagaaatgcatgtttatggcttttttgtaaatataaatgcagtgatctatggcttaaaaaatttgtttctgtgacaatgtttgtaaatctagccaatagagtcatttacagaagaaaaatgagcatgtaataatacaagaactgtttccccctcaaaacctgaacctgaattatttgtaaaaactgaaatttaatgattaaagagaagccagaattgta

SEQ ID NO: 307965 - DNA, 1716 bp, Homo sapiens
acgagctgggccgggcggccgtgcgggagccatggcggcctcggaggcggcggcggcggcggggtccgcggctctggcggcgggtgcccgggccgtcccggcggccacgacaggagccgccgccgccgcctcgggcccgtgggtgcccccgggaccccgactgaggggcagccggccgcggcccgcgggggcgacgcagcagcccgctgtccccgcgccgccggcgggggagctgatccagccgtcggtgagcgagctgtcccgggccgtgcggaccaacatcctgtgcaccgtgcgcggctgcggcaagatcctgcccaacagccccgcgctcaacatgcacctagtcaagagccaccgcctgcaggatggcatagtcaatccaacaataagaaaagatttgaaaactggaccgaaattctactgctgtccaattgaaggctgccccagaggccctgagagaccgttttctcagttttctctcgtaaaacagcactttatgaaaatgcatgctgagaagaagcacaaatgtagtaagtgcagcaattcgtacggtacagaatgggacctgaaaagacatgcagaggactgtggcaagaccttccggtgcacatgcggctgtccctacgccagtagaacagcactgcagtctcacatctaccgaactgggcacgagatacctgcagaacacagggacccacctagtaagaaaaggaaaatggaaaactgtgcacaaaaccagaagttatccaacaagaccattgaatcattgaacaaccaaccaatccctagaccagacactcaagaactagaagcttcagaaataaagctagaaccatcttttgaagactcttgtggctctaacactgacaagcagactcttacaacaccaccgagatatcctcagaagttgcttttaccaaagcccaaagtggctttggttaaactacccgtgatgcagttttctgtcatgcctgtctttgtgcctacagccgactcctcagcccagcctgtggtgttaggtgttgatcagggctctgccacaggggctgtgcacttaatgcccttgtcagtaggaaccctgatcctcggcctagattcagaggcttgctctcttaaggagagcctacctcttttcaaaattgctaatcctattgctggtgagccaataagtactggtgttcaagtgaactttggtaaaagtccatctaatcctttacaagaactagggaacacgtgtcaaaagaatagcatttcttcaatcaacgtgcagacagatctgtcttatgcctcacaaaactttataccttctgcacagtgggccactgctgattcctctgtgtcgtcttgttctcaaactgatttgtcgtttgattctcaagtgtctcttcccattagtgttcacactcagacatttttgcccagctctaaggtaacttcatctatagctgctcagactgatgcatttatggacacctgtttccagtcaggtgggagtctccaacttctaaaactaacggtggagtccatgtgtgaaatggcatctaccatttcctctggattaaaactacggactggggacaacagtattaattcgattgaatgtggctgatgatgcagttgcttagcttctttgtgtttctttgccttttgtacttgtaaacagaaatttgcgtataaatgtgagtgtattataaagtttgagatgttgatcta

SEQ ID NO: 307966 - DNA, 1391 bp, Homo sapiens
ggggcgggaaggggtggtttttctgttttacggggggcagagtcgggaaaaatggaaaaaaagaaaggggagaacagggggggcgggcaatttcggggaatttttttttaaaaaaaaaaaaaaaaaaaaaaaaaaaaaaaaagtcgccagcaacaagcacgtagtgtagtgttcctgctaaatgagcataggttatccaaaccttgggaacagggagttatggaaacgtgcctatgacttcatcttggggtgtgtcctatgaagatcctttctggtctccacagtaggccagagttgggggctctggagctgtttccccaagtgcatccacaagctggatctgagttttgtcactctaaaattaaacaagaaaaaaagtgggaaaagggcatcccccattaggtttcaatactttgcacttctactaagcttgatagggcaggagtgcaatctacaattattttaaagtgaatttccttccattcaccattctttatcttttctttgaataagaaaaagtatctagcaaggatattacttgtgccttgaggctagcaattataggatagattcatctaaaatatggtattctgcattttggttttttttcttaagtgaataataccagtcttcaaagaaaacaaggtgaagacctattgcttcaataatcaagaatgctttgtgtgttttgaggtaggagcatgatcaagtatgctttggggattttctgtatttaggagatcctggattcttaattgttggctaagttccagtcaagtaggaatcagtgcagcctgtaagttctccacattgacacacacacacacacacacacacacacacacgacatgctcctttctgtggcacatgcctgtattactgaaagctaaatcctcaaaacctagtaaggggaccaatgattcattaaagtaaattgatggttttgctactaattcctatcccatacatttgacacaaaagaagtgttggtaatggataaataacatatcccgggcagatgagctcaacctagtaggtaagagtttggtttggtcacagttgcctatgagtgtgggtttcaaaagaaacataaagccttaacttagaatttcattatgttttagaatcatcactgccttaatattcaagcatctatttaagtcctaataaaggagaaatgcatgtttatggcttttttgtaaatataaatgcagtgatctatggcttaaaaaatttgtttctgtgacaatgtttgtaaatctagccaatagagtcatttacagaagaaaaatgagcatgtaataatacaagaactgtttccccctcaaaacctgaacctgaattatttgtaaaaactgaaatttaatgattaaagagaagccagaattgta

SEQ ID NO: 307967 - DNA, 1095 bp, Homo sapiens
cagctaggaagaattcataacctagaactactcgtgagagaacatcagagaacctaatatgagaatcgttctctaaaaaaagtgggaaaagggcatcccccattaggtttcaatactttgcacttctactaagcttgatagggcaggagtgcaatctacaattattttaaagtgaatttccttccattcaccattctttatcttttctttgaataagaaaaagtatctagcaaggatattacttgtgccttgaggctagcaattataggatagattcatctaaaatatggtattctgcattttggttttttttcttaagtgaataataccagtcttcaaagaaaacaaggtgaagacctattgcttcaataatcaagaatgctttgtgtgttttgaggtaggagcatgatcaagtatgctttggggattttctgtatttaggagatcctggattcttaattgttggctaagttccagtcaagtaggaatcagtgcagcctgtaagttctccacattgacacacacacacacacacacacacacacacacgacatgctcctttctgtggcacatgcctgtattactgaaagctaaatcctcaaaacctagtaaggggaccaatgattcattaaagtaaattgatggttttgctactaattcctatcccatacatttgacacaaaagaagtgttggtaatggataaataacatatcccgggcagatgagctcaacctagtaggtaagagtttggtttggtcacagttgcctatgagtgtgggtttcaaaagaaacataaagccttaacttagaatttcattatgttttagaatcatcactgccttaatattcaagcatctatttaagtcctaataaaggagaaatgcatgtttatggcttttttgtaaatataaatgcagtgatctatggcttaaaaaatttgtttctgtgacaatgtttgtaaatctagccaatagagtcatttacagaagaaaaatgagcatgtaataatacaagaactgtttccccctcaaaacctgaacctgaattatttgtaaaaactgaaatttaatgattaaagagaagccagaattgta

SEQ ID NO: 307968 - DNA, 610 bp, Homo sapiens
taacctactgtttttactacctgtttcagacttcctgtctcccttatccctagcctttttccatgtgataactctcccttagctgagaagccggaggactccatttgttccttcatttacaggacatcaaggactccttacccaccccctttcctcaaggagttaacttgtgtaaactgattaatcatttgacacaaaagaagtgttggtaatggataaataacatatcccgggcagatgagctcaacctagtaggtaagagtttggtttggtcacagttgcctatgagtgtgggtttcaaaagaaacataaagccttaacttagaatttcattatgttttagaatcatcactgccttaatattcaagcatctatttaagtcctaataaaggagaaatgcatgtttatggcttttttgtaaatataaatgcagtgatctatggcttaaaaaatttgtttctgtgacaatgtttgtaaatctagccaatagagtcatttacagaagaaaaatgagcatgtaataatacaagaactgtttccccctcaaaacctgaacctgaattatttgtaaaaactgaaatttaatgattaaagagaagccagaattgta

SEQ ID NO: 307969 - DNA, 1192 bp, Homo sapiens
tttattgaacatttattctgttcaaaacattcccaaaggcaacagaagatacaaataaatctctgcccatgaaaaggtgtggggggcattagaaggcgttctcttcggtgtaatgaagtaatgagagaagaaaaagtagtttgaagctatggagtaagggactttgagtatcccaggctcaaaaagttgggacttgaacagtacgggggtgctgctgaaaacgtttgagggaggtaatgacatgatcgaagctatacttgagaaaggtgaatctgataaagtatgagtgaaaaagagactgaaggtctagaaattagattgaggctaatgacaaaatccacataaataggaggacttgaacgaaggggcacttagaagaggacaggagatagtaaaaggcattcaatgatgagagcacacactacaggggagcatgagggaggttggaaaagataatgaaaggattaccgagcttcactgacgatgtgtttgaaatgagcaggaatcttgtagtgatcctaatccgtggttttctggagcatttcacagcctaggaacatacaaggggggcatctccctggaatgtaaattgactaagaggaattcaataatggtcaaatgaatgcagaattttagagtcttgcttagtattctcaccacatttcgtttagtctactcatactctttttctcttactgctgacactagatggaaaaactcttaattaaaagtatttcacaaaatgtgctcgttttcagtcattccgtttccactccagcctgttgtgttgtttttttgaaataataatttaaagtaattttccttttgcaggatggcatagtcaatccaacaataagaaaagatttgaaaactggaccgaaattctactgctgtccaattgaaggctgccccagaggccctgagagaccgttttctcagttttctctcgtaaaacaggtactctctactctgaggatgagatacagatgctaaaaacctattgtgcattctgattacttagcagacataactacagaattgagtagacagctgcttgtgaggggagatgcctgcgtgtctcccagttggtataaacctgagtatgctgttacacaagtggagggaaaagcggcacggtctggagggaatatgtctagaagtgagttaaaatacagagagagagagtaaacca

SEQ ID NO: 307970 - DNA, 2708 bp, Homo sapiens
acgagctgggccgggcggccgtgcgggagccatggcggcctcggaggcggcggcggcggcggggtccgcggctctggcggcgggtgcccgggccgtcccggcggccacgacaggagccgccgccgccgcctcgggcccgtgggtgcccccgggaccccgactgaggggcagccggccgcggcccgcgggggcgacgcagcagcccgctgtccccgcgccgccggcgggggagctgatccagccgtcggtgagcgagctgtcccgggccgtgcggaccaacatcctgtgcaccgtgcgcggctgcggcaagatcctgcccaacagccccgcgctcaacatgcacctagtcaagagccaccgcctgcaggatggcatagtcaatccaacaataagaaaagatttgaaaactggaccgaaattctactgctgtccaattgaaggctgccccagaggccctgagagaccgttttctcagttttctctcgtaaaacagcactttatgaaaatgcatgctgagaagaagcacaaatgtagtaagtgcagcaattcgtacggtacagaatgggacctgaaaagacatgcagaggactgtggcaagaccttccggtgcacatgcggctgtccctacgccagtagaacagcactgcagtctcacatctaccgaactgggcacgagatacctgcagaacacagggacccacctagtaagaaaaggaaaatggaaaactgtgcacaaaaccagaagttatccaacaagaccattgaatcattgaacaaccaaccaatccctagaccagacactcaagaactagaagcttcagaaataaagctagaaccatcttttgaagactcttgtggctctaacactgacaagcagactcttacaacaccaccgagatatcctcagaagttgcttttaccaaagcccaaagtggctttggttaaactacccgtgatgcagttttctgtcatgcctgtctttgtgcctacagccgactcctcagcccagcctgtggtgttaggtgttgatcagggctctgccacaggggctgtgcacttaatgcccttgtcagtaggaaccctgatcctcggcctagattcagaggcttgctctcttaaggagagcctacctcttttcaaaattgctaatcctattgctggtgagccaataagtactggtgttcaagtgaactttggtaaaagtccatctaatcctttacaagaactagggaacacgtgtcaaaagaatagcatttcttcaatcaacgtgcagacagatctgtcttatgcctcacaaaactttataccttctgcacagtgggccactgctgattcctctgtgtcgtcttgttctcaaactgatttgtcgtttgattctcaagtgtctcttcccattagtgttcacactcagacatttttgcccagctctaaggtaacttcatctatagctgctcagactgatgcatttatggacacctgtttccagtcaggtggggtctccagagaaactcaaaccagtgggatagaaagtccaacggatgaccatgtacagatggaccaagctggaatgtgcggagacatttttgagagtgttcattcatcatataatgttgctacaggtaacattataagcaacagtttagtagcagagacagtaactcatagtttgttacctcagaatgagcctaagactttaaatcaagatattgagaaatctgcaccaattataaatttcagtgcacagaatagtatgcttccttcacagaacatgacagataatcagacccaaaccatagatttattaagtgatttggaaaacatcttgtcaagtaatctgcctgcccagacattggatcatcgtagtcttttgtctgacacaaatcctggacctgacacccagctcccatctggcccagcccagaaccccggaatcgattttgatatcgaagagttcttttcggcctcaaatatccagactcaaactgaagagagtgaacttagcaccatgaccaccgagccagtcttggagtcactggacatagagactcaaacggacttcttactcgcagatacctctgctcagtcctatgggtgtaggggaaattctaacttcttaggccttgagatgtttgacacacagacacagacagacttaaactttttcttagacagtagccctcatctgcctctgggaagtattctgaaacactccagcttttccgtgagtactgattcatctgacacagagacccaaactgaaggagtctccactgctaaaaatatacctgctctagaaagcaaagttcagttgaacagtacagaaacacagaccatgagttctgggtttgaaaccctggggagcttgttcttcaccagcaacgaaactcagacagcaatggatgactttcttctggctgatctggcctggaacacgatggagtctcagttcagctctgtagaaacccagacttctgcggaaccacacacagtctccaacttctaaaactaacggtggagtccatgtgtgaaatggcatctaccatttcctctggattaaaactacggactggggacaacagtattaattcgattgaatgtggctgatgatgcagttgcttagcttctttgtgtttctttgccttttgtacttgtaaacagaaatttgcgtataaatgtgagtgtattataaagtttgagatgttgatcta

SEQ ID NO: 307971 - DNA, 4880 bp, Homo sapiens
acgagctgggccgggcggccgtgcgggagccatggcggcctcggaggcggcggcggcggcggggtccgcggctctggcggcgggtgcccgggccgtcccggcggccacgacaggagccgccgccgccgcctcgggcccgtgggtgcccccgggaccccgactgaggggcagccggccgcggcccgcgggggcgacgcagcagcccgctgtccccgcgccgccggcgggggagctgatccagccgtcggtgagcgagctgtcccgggccgtgcggaccaacatcctgtgcaccgtgcgcggctgcggcaagatcctgcccaacagccccgcgctcaacatgcacctagtcaagagccaccgcctgcaggatggcatagtcaatccaacaataagaaaagatttgaaaactggaccgaaattctactgctgtccaattgaaggctgccccagaggccctgagagaccgttttctcagttttctctcgtaaaacagcactttatgaaaatgcatgctgagaagaagcacaaatgtagtaagtgcagcaattcgtacggtacagaatgggacctgaaaagacatgcagaggactgtggcaagaccttccggtgcacatgcggctgtccctacgccagtagaacagcactgcagtctcacatctaccgaactgggcacgagatacctgcagaacacagggacccacctagtaagaaaaggaaaatggaaaactgtgcacaaaaccagaagttatccaacaagaccattgaatcattgaacaaccaaccaatccctagaccagacactcaagaactagaagcttcagaaataaagctagaaccatcttttgaagactcttgtggctctaacactgacaagcagactcttacaacaccaccgagatatcctcagaagttgcttttaccaaagcccaaagtggctttggttaaactacccgtgatgcagttttctgtcatgcctgtctttgtgcctacagccgactcctcagcccagcctgtggtgttaggtgttgatcagggctctgccacaggggctgtgcacttaatgcccttgtcagtaggaaccctgatcctcggcctagattcagaggcttgctctcttaaggagagcctacctcttttcaaaattgctaatcctattgctggtgagccaataagtactggtgttcaagtgaactttggtaaaagtccatctaatcctttacaagaactagggaacacgtgtcaaaagaatagcatttcttcaatcaacgtgcagacagatctgtcttatgcctcacaaaactttataccttctgcacagtgggccactgctgattcctctgtgtcgtcttgttctcaaactgatttgtcgtttgattctcaagtgtctcttcccattagtgttcacactcagacatttttgcccagctctaaggtaacttcatctatagctgctcagactgatgcatttatggacacctgtttccagtcaggtggggtctccagagaaactcaaaccagtgggatagaaagtccaacggatgaccatgtacagatggaccaagctggaatgtgcggagacatttttgagagtgttcattcatcatataatgttgctacaggtaacattataagcaacagtttagtagcagagacagtaactcatagtttgttacctcagaatgagcctaagactttaaatcaagatattgagaaatctgcaccaattataaatttcagtgcacagaatagtatgcttccttcacagaacatgacagataatcagacccaaaccatagatttattaagtgatttggaaaacatcttgtcaagtaatctgcctgcccagacattggatcatcgtagtcttttgtctgacacaaatcctggacctgacacccagctcccatctggcccagcccagaaccccggaatcgattttgatatcgaagagttcttttcggcctcaaatatccagactcaaactgaagagagtgaacttagcaccatgaccaccgagccagtcttggagtcactggacatagagactcaaacggacttcttactcgcagatacctctgctcagtcctatgggtgtaggggaaattctaacttcttaggccttgagatgtttgacacacagacacagacagacttaaactttttcttagacagtagccctcatctgcctctgggaagtattctgaaacactccagcttttccgtgagtactgattcatctgacacagagacccaaactgaaggagtctccactgctaaaaatatacctgctctagaaagcaaagttcagttgaacagtacagaaacacagaccatgagttctgggtttgaaaccctggggagcttgttcttcaccagcaacgaaactcagacagcaatggatgactttcttctggctgatctggcctggaacacgatggagtctcagttcagctctgtagaaacccagacttctgcggaaccacacacagtctccaacttctaaaactaacggtggagtccatgtgtgaaatggcatctaccatttcctctggattaaaactacggactggggacaacagtattaattcgattgaatgtggctgatgatgcagttgcttagcttctttgtgtttctttgccttttgtacttgtaaacagaaatttgcgtataaatgtgagtgtattataaagtttgagatgttgatctaaattgtttttgtgttgcctacatttgccttttcacagctagtcttttcatgttaaaaaaaaaatgtatttcatatctataaaacctatatagccatttagctgaagcccagcttaccaggttcaagggtacaaacttctcaaatcttcaaaacattttagtcaaagtgtaatatacttaaactgcacctaaaatatctttggcactgcttgttagaaattcctgattcctgttactaatcactaaagaaaccggatgctgccaccgtaggatttaagcagtagtgcttccatgctcttaagactcctgctgcctggaccttcgtcagctttgacacctcttttctgatttaaagacaccaaggaaaactacaactgtctttagctttgaagcagttttcatgtaatcattgccacctcttcgctacatgaactactattgataccagcatacaagtgtatagcactttacacacaagaggtttattgatgtaaaattatcggctagggaagcagcagcgggccaggtgtggtggcttacccctgtaatcccagcactttgggaggccaaagcaggacgatcacttgagcccaggagttcaacaccagcttgggcaacataagaagaccgtgtctctggaatttttttttttttttaattagccaggcacagtggcatgcgcctgtgatcccagctacttggaaggctgaggtgagaggatcactcgaggagattggggctgccatgagccatggtcttggcactgtactccaacctgggtaacagggcaagaccctatctcaaaaaaaaaaaaaaagtcgccagcaacaagcacgtagtgtagtgttcctgctaaatgagcataggttatccaaaccttgggaacagggagttatggaaacgtgcctatgacttcatcttggggtgtgtcctatgaagatcctttctggtctccacagtaggccagagttgggggctctggagctgtttccccaagtgcatccacaagctggatctgagttttgtcactctaaaattaaacaagaaaaaaagtgggaaaagggcatcccccattaggtttcaatactttgcacttctactaagcttgatagggcaggagtgcaatctacaattattttaaagtgaatttccttccattcaccattctttatcttttctttgaataagaaaaagtatctagcaaggatattacttgtgccttgaggctagcaattataggatagattcatctaaaatatggtattctgcattttggttttttttcttaagtgaataataccagtcttcaaagaaaacaaggtgaagacctattgcttcaataatcaagaatgctttgtgtgttttgaggtaggagcatgatcaagtatgctttggggattttctgtatttaggagatcctggattcttaattgttggctaagttccagtcaagtaggaatcagtgcagcctgtaagttctccacattgacacacacacacacacacacacacacacacacgacatgctcctttctgtggcacatgcctgtattactgaaagctaaatcctcaaaacctagtaaggggaccaatgattcattaaagtaaattgatggttttgctactaattcctatcccatacatttgacacaaaagaagtgttggtaatggataaataacatatcccgggcagatgagctcaacctagtaggtaagagtttggtttggtcacagttgcctatgagtgtgggtttcaaaagaaacataaagccttaacttagaatttcattatgttttagaatcatcactgccttaatattcaagcatctatttaagtcctaataaaggagaaatgcatgtttatggcttttttgtaaatataaatgcagtgatctatggcttaaaaaatttgtttctgtgacaatgtttgtaaatctagccaatagagtcatttacagaagaaaaatgagcatgtaataatacaagaactgtttccccctcaaaacctgaacctgaattatttgtaaaaactgaaatttaatgattaaagagaagccagaattgtacccttttttgtgaattcttgaacgtactcataaatatgacttattgtattgccttaagttttcactcattgtcttttgaaagccatatgataaaatgattttattta

SEQ ID NO: 307972 - DNA, 4773 bp, Homo sapiens
acgagctgggccgggcggccgtgcgggagccatggcggcctcggaggcggcggcggcggcggggtccgcggctctggcggcgggtgcccgggccgtcccggcggccacgacaggagccgccgccgccgcctcgggcccgtgggtgcccccgggaccccgactgaggggcagccggccgcggcccgcgggggcgacgcagcagcccgctgtccccgcgccgccggcgggggagctgatccagccgtcggtgagcgagctgtcccgggccgtgcggaccaacatcctgtgcaccgtgcgcggctgcggcaagatcctgcccaacagccccgcgctcaacatgcacctagtcaagagccaccgcctgcaggatggcatagtcaatccaacaataagaaaagatttgaaaactggaccgaaattctactgctgtccaattgaaggctgccccagaggccctgagagaccgttttctcagttttctctcgtaaaacagcactttatgaaaatgcatgctgagaagaagcacaaatgtagtaagtgcagcaattcgtacggtacagaatgggacctgaaaagacatgcagaggactgtggcaagaccttccggtgcacatgcggctgtccctacgccagtagaacagcactgcagtctcacatctaccgaactgggcacgagatacctgcagaacacagggacccacctagtaagaaaaggaaaatggaaaactgtgcacaaaaccagaagttatccaacaagaccattgaatcattgaacaaccaaccaatccctagaccagacactcaagaactagaagcttcagaaataaagctagaaccatcttttgaagactcttgtggctctaacactgacaagcagactcttacaacaccaccgagatatcctcagaagttgcttttaccaaagcccaaagtggctttggttaaactacccgtgatgcagttttctgtcatgcctgtctttgtgcctacagccgactcctcagcccagcctgtggtgttaggtgttgatcagggctctgccacaggggctgtgcacttaatgcccttgtcagtaggaaccctgatcctcggcctagattcagaggcttgctctcttaaggagagcctacctcttttcaaaattgctaatcctattgctggtgagccaataagtactggtgttcaagtgaactttggtaaaagtccatctaatcctttacaagaactagggaacacgtgtcaaaagaatagcatttcttcaatcaacgtgcagacagatctgtcttatgcctcacaaaactttataccttctgcacagtgggccactgctgattcctctgtgtcgtcttgttctcaaactgatttgtcgtttgattctcaagtgtctcttcccattagtgttcacactcagacatttttgcccagctctaaggtaacttcatctatagctgctcagactgatgcatttatggacacctgtttccagtcaggtggggtctccagagaaactcaaaccagtgggatagaaagtccaacggatgaccatgtacagatggaccaagctggaatgtgcggagacatttttgagagtgttcattcatcatataatgttgctacaggtaacattataagcaacagtttagtagcagagacagtaactcatagtttgttacctcagaatgagcctaagactttaaatcaagatattgagaaatctgcaccaattataaatttcagtgcacagaatagtatgcttccttcacagaacatgacagataatcagacccaaaccatagatttattaagtgatttggaaaacatcttgtcaagtaatctgcctgcccagacattggatcatcgtagtcttttgtctgacacaaatcctggacctgacacccagctcccatctggcccagcccagaaccccggaatcgattttgatatcgaagagttcttttcggcctcaaatatccagactcaaactgaagagagtgaacttagcaccatgaccaccgagccagtcttggagtcactggacatagagactcaaacggacttcttactcgcagatacctctgctcagtcctatgggtgtaggggaaattctaacttcttaggccttgagatgtttgacacacagacacagacagacttaaactttttcttagacagtagccctcatctgcctctgggaagtattctgaaacactccagcttttccgtgagtactgattcatctgacacagagacccaaactgaaggagtctccactgctaaaaatatacctgctctagaaagcaaagttcagttgaacagtacagaaacacagaccatgagttctgggtttgaaaccctggggagcttgttcttcaccagcaacgaaactcagacagcaatggatgactttcttctggctgatctggcctggaacacgatggagtctcagttcagctctgtagaaacccagacttctgcggaaccacacacagtctccaacttctaaaactaacggtggagtccatgtgtgaaatggcatctaccatttcctctggattaaaactacggactggggacaacagtattaattcgattgaatgtggctgatgatgcagttgcttagcttctttgtgtttctttgccttttgtacttgtaaacagaaatttgcgtataaatgtgagtgtattataaagtttgagatgttgatctaaattgtttttgtgttgcctacatttgccttttcacagctagtcttttcatgttaaaaaaaaaatgtatttcatatctataaaacctatatagccatttagctgaagcccagcttaccaggttcaagggtacaaacttctcaaatcttcaaaacattttagtcaaagtgtaatatacttaaactgcacctaaaatatctttggcactgcttgttagaaattcctgattcctgttactaatcactaaagaaaccggatgctgccaccgtaggatttaagcagtagtgcttccatgctcttaagactcctgctgcctggaccttcgtcagctttgacacctcttttctgatttaaagacaccaaggaaaactacaactgtctttagctttgaagcagttttcatgtaatcattgccacctcttcgctacatgaactactattgataccagcatacaagtgtatagcactttacacacaagaggtttattgatgtaaaattatcggctagggaagcagcagcgggccaggtgtggtggcttacccctgtaatcccagcactttgggaggccaaagcaggacgatcacttgagcccaggagttcaacaccagcttgggcaacataagaagaccgtgtctctggaatttttttttttttttaattagccaggcacagtggcatgcgcctgtgatcccagctacttggaaggctgaggtgagaggatcactcgaggagattggggctgccatgagccatggtcttggcactgtactccaacctgggtaacagggcaagaccctatctcaaaaaaaaaaaaaaagtcgccagcaacaagcacgtagtgtagtgttcctgctaaatgagcataggttatccaaaccttgggaacagggagttatggaaacgtgcctatgacttcatcttggggtgtgtcctatgaagatcctttctggtctccacagtaggccagagttgggggctctggagctgtttccccaagtgcatccacaagctggatctgagttttgtcactctaaaattaaacaagaaaaaaagtgggaaaagggcatcccccattaggtttcaatactttgcacttctactaagcttgatagggcaggagtgcaatctacaattattttaaagtgaatttccttccattcaccattctttatcttttctttgaataagaaaaagtatctagcaaggatattacttgtgccttgaggctagcaattataggatagattcatctaaaatatggtattctgcattttggttttttttcttaagtgaataataccagtcttcaaagaaaacaaggtgaagacctattgcttcaataatcaagaatgctttgtgtgttttgaggtaggagcatgatcaagtatgctttggggattttctgtatttaggagatcctggattcttaattgttggctaagttccagtcaagtaggaatcagtgcagcctgtaagttctccacattgacacacacacacacacacacacacacacacacgacatgctcctttctgtggcacatgcctgtattactgaaagctaaatcctcaaaacctagtaaggggaccaatgattcattaaagtaaattgatggttttgctactaattcctatcccatacatttgacacaaaagaagtgttggtaatggataaataacatatcccgggcagatgagctcaacctagtaggtaagagtttggtttggtcacagttgcctatgagtgtgggtttcaaaagaaacataaagccttaacttagaatttcattatgttttagaatcatcactgccttaatattcaagcatctatttaagtcctaataaaggagaaatgcatgtttatggcttttttgtaaatataaatgcagtgatctatggcttaaaaaatttgtttctgtgacaatgtttgtaaatctagccaatagagtcatttacagaagaaaaatgagcatgtaataatacaagaactgtttccccctcaaaacctgaacctgaattatttgtaaaaactgaaatttaatgattaaagagaagccagaattgta

SEQ ID NO: 307973 - DNA, 5130 bp, Homo sapiens
acgagctgggccgggcggccgtgcgggagccatggcggcctcggaggcggcggcggcggcggggtccgcggctctggcggcgggtgcccgggccgtcccggcggccacgacaggagccgccgccgccgcctcgggcccgtgggtgcccccgggaccccgactgaggggcagccggccgcggcccgcgggggcgacgcagcagcccgctgtccccgcgccgccggcgggggagctgatccagccgtcggtgagcgagctgtcccgggccgtgcggaccaacatcctgtgcaccgtgcgcggctgcggcaagatcctgcccaacagccccgcgctcaacatgcacctagtcaagagccaccgcctgcaggatggcatagtcaatccaacaataagaaaagatttgaaaactggaccgaaattctactgctgtccaattgaaggctgccccagaggccctgagagaccgttttctcagttttctctcgtaaaacagcactttatgaaaatgcatgctgagaagaagcacaaatgtagtaagtgcagcaattcgtacggtacagaatgggacctgaaaagacatgcagaggactgtggcaagaccttccggtgcacatgcggctgtccctacgccagtagaacagcactgcagtctcacatctaccgaactgggcacgagatacctgcagaacacagggacccacctagtaagaaaaggaaaatggaaaactgtgcacaaaaccagaagttatccaacaagaccattgaatcattgaacaaccaaccaatccctagaccagacactcaagaactagaagcttcagaaataaagctagaaccatcttttgaagactcttgtggctctaacactgacaagcagactcttacaacaccaccgagatatcctcagaagttgcttttaccaaagcccaaagtggctttggttaaactacccgtgatgcagttttctgtcatgcctgtctttgtgcctacagccgactcctcagcccagcctgtggtgttaggtgttgatcagggctctgccacaggggctgtgcacttaatgcccttgtcagtaggaaccctgatcctcggcctagattcagaggcttgctctcttaaggagagcctacctcttttcaaaattgctaatcctattgctggtgagccaataagtactggtgttcaagtgaactttggtaaaagtccatctaatcctttacaagaactagggaacacgtgtcaaaagaatagcatttcttcaatcaacgtgcagacagatctgtcttatgcctcacaaaactttataccttctgcacagtgggccactgctgattcctctgtgtcgtcttgttctcaaactgatttgtcgtttgattctcaagtgtctcttcccattagtgttcacactcagacatttttgcccagctctaaggtaacttcatctatagctgctcagactgatgcatttatggacacctgtttccagtcaggtggggtctccagagaaactcaaaccagtgggatagaaagtccaacggatgaccatgtacagatggaccaagctggaatgtgcggagacatttttgagagtgttcattcatcatataatgttgctacaggtaacattataagcaacagtttagtagcagagacagtaactcatagtttgttacctcagaatgagcctaagactttaaatcaagatattgagaaatctgcaccaattataaatttcagtgcacagaatagtatgcttccttcacagaacatgacagataatcagacccaaaccatagatttattaagtgatttggaaaacatcttgtcaagtaatctgcctgcccagacattggatcatcgtagtcttttgtctgacacaaatcctggacctgacacccagctcccatctggcccagcccagaaccccggaatcgattttgatatcgaagagttcttttcggcctcaaatatccagactcaaactgaagagagtgaacttagcaccatgaccaccgagccagtcttggagtcactggacatagagactcaaacggacttcttactcgcagatacctctgctcagtcctatgggtgtaggggaaattctaacttcttaggccttgagatgtttgacacacagacacagacagacttaaactttttcttagacagtagccctcatctgcctctgggaagtattctgaaacactccagcttttccgtgagtactgattcatctgacacagagacccaaactgaaggagtctccactgctaaaaatatacctgctctagaaagcaaagttcagttgaacagtacagaaacacagaccatgagttctgggtttgaaaccctggggagcttgttcttcaccagcaacgaaactcagacagcaatggatgactttcttctggctgatctggcctggaacacgatggagtctcagttcagctctgtagaaacccagacttctgcggaaccacacacagtctccaacttctaaaactaacggtggagtccatgtgtgaaatggcatctaccatttcctctggattaaaactacggactggggacaacagtattaattcgattgaatgtggctgatgatgcagttgcttagcttctttgtgtttctttgccttttgtacttgtaaacagaaatttgcgtataaatgtgagtgtattataaagtttgagatgttgatctaaattgtttttgtgttgcctacatttgccttttcacagctagtcttttcatgttaaaaaaaaaatgtatttcatatctataaaacctatatagccatttagctgaagcccagcttaccaggttcaagggtacaaacttctcaaatcttcaaaacattttagtcaaagtgtaatatacttaaactgcacctaaaatatctttggcactgcttgttagaaattcctgattcctgttactaatcactaaagaaaccggatgctgccaccgtaggatttaagcagtagtgcttccatgctcttaagactcctgctgcctggaccttcgtcagctttgacacctcttttctgatttaaagacaccaaggaaaactacaactgtctttagctttgaagcagttttcatgtaatcattgccacctcttcgctacatgaactactattgataccagcatacaagtgtatagcactttacacacaagaggtttattgatgtaaaattatcggctagggaagcagcagcgggccaggtgtggtggcttacccctgtaatcccagcactttgggaggccaaagcaggacgatcacttgagcccaggagttcaacaccagcttgggcaacataagaagaccgtgtctctggaatttttttttttttttaattagccaggcacagtggcatgcgcctgtgatcccagctacttggaaggctgaggtgagaggatcactcgaggagattggggctgccatgagccatggtcttggcactgtactccaacctgggtaacagggcaagaccctatctcaaaaaaaaaaaaaaagtcgccagcaacaagcacgtagtgtagtgttcctgctaaatgagcataggttatccaaaccttgggaacagggagttatggaaacgtgcctatgacttcatcttggggtgtgtcctatgaagatcctttctggtctccacagtaggccagagttgggggctctggagctgtttccccaagtgcatccacaagctggatctgagttttgtcactctaaaattaaacaagaaaaaaagtgggaaaagggcatcccccattaggtttcaatactttgcacttctactaagcttgatagggcaggagtgcaatctacaattattttaaagtgaatttccttccattcaccattctttatcttttctttgaataagaaaaagtatctagcaaggatattacttgtgccttgaggctagcaattataggatagattcatctaaaatatggtattctgcattttggttttttttcttaagtgaataataccagtcttcaaagaaaacaaggtgaagacctattgcttcaataatcaagaatgctttgtgtgttttgaggtaggagcatgatcaagtatgctttggggattttctgtatttaggagatcctggattcttaattgttggctaagttccagtcaagtaggaatcagtgcagcctgtaagttctccacattgacacacacacacacacacacacacacacacacgacatgctcctttctgtggcacatgcctgtattactgaaagctaaatcctcaaaacctagtaaggggaccaatgattcattaaagtaaattgatggttttgctactaattcctatcccatacatttgacacaaaagaagtgttggtaatggataaataacatatcccgggcagatgagctcaacctagtaggtaagagtttggtttggtcacagttgcctatgagtgtgggtttcaaaagaaacataaagccttaacttagaatttcattatgttttagaatcatcactgccttaatattcaagcatctatttaagtcctaataaaggagaaatgcatgtttatggcttttttgtaaatataaatgcagtgatctatggcttaaaaaatttgtttctgtgacaatgtttgtaaatctagccaatagagtcatttacagaagaaaaatgagcatgtaataatacaagaactgtttccccctcaaaacctgaacctgaattatttgtaaaaactgaaatttaatgattaaagagaagccagaattgtaaaaaaaaaaacaaaaaaaaaaaaaaaaaaaaaaaaaaaaaatgttgtgggggggcctggggccctgtgggaaaagctcttcaaaacacactcggttgggggcggcgcggggcccacatatggtgtaacgtggaacacggggcctcaaacgcgtgttcccagaggaagaaccgcggcgcaatagaaccacaggaggctgtgggattctccagccacaaataagaaaaccccgcggggagaaacacccaaggcgcttcctgagaaaattcccaagagtggagcccccgaaggcgccacaccgggggacctcactcaccgggggagctcacaagcaggacccgcaattcaaaattaccca

SEQ ID NO: 307974 - DNA, 711 bp, Homo sapiens
  misc_feature (679)..(679): n is a, c, g, or t
  misc_feature (687)..(687): n is a, c, g, or t
cgactctagaggtcccccattcgcggattcaccaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccaggcntgtatgangcagcagtgtcaaggcagtgttct

SEQ ID NO: 307975 - DNA, 464 bp, Homo sapiens
agcagatagtgaagtgtttacttttgtgtttcttgacaggccttgtatgaagcaggagaaaggagaaaggggacagacgtaaacgtgttcaataccatccttaccaccagaagctatccacaacttcgcagaggtaacaataaatttctttttctggaatctgtttatggaagatgcaattttcttttttgatgacaaataagagaaagtaaaaacagaaccctttttcaatatcactcctgtatcaaacagatacagtgttcctgacccattgttatttgtcaatttgtccaattttgtacagccgctactttatcatatttaatacattttgtgacttgggcatgtggaacataattttgttattttcactgcttttactcccctaaaagatttggaatatgtgtgggaaaagacatgcataacagaacaaatgaaattagaatgaagaaaaacaaaaaaaa

SEQ ID NO: 307976 - DNA, 447 bp, Homo sapiens
gtctagacggatcccatgcgcgcgcttccatcaagcatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagcaagcgtcgcgcatgcgcgacgcttccatcaaactcatactcgtccttaccgggggccgtggccttctgtggctctgggttcttggccttgtgcttgaggcctttttcgaactcggagtccgtgttgttgccgtcgactgaactggaaggtgcgaaggatggtgcgtcttcctcttctgagctctccgtcgagctctcctcgc

SEQ ID NO: 307977 - DNA, 302 bp, Homo sapiens
ctctcgaggataccctctggatgcaagtgtcacagatcattcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagagacactttgcatccagaggacactttgcatccagaggggatcctctaggctcg

SEQ ID NO: 307978 - DNA, 1936 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaaaacaccacacaacacaacgaaacacagaaaacaaaacaaaagaaaggacgaaagaaaaacaaaacaacccacagaggagacaaggaaagaaaaccaccagaacagaagcagacgagacaacaaagaagaggaaaaaagagaaaagaccggacgagaacacccgagcagatgacaaagactcaagagacaaagagagaaaaacaactaatgcaggggaaggagaaaggagaaaacaaaagagataaacgaacacagaaaaacaacaacggccgcagagaaaaagaacatacaagaaagaaactaagaaagagaagaatagacaagaaagacaagaaaacagaaagaaagaaacaaaatcgagacaacgaaaacacgaagaagcccgaaagaagaacaagaagcaagcgacagacaagccaagcagagc

SEQ ID NO: 307979 - DNA, 1804 bp, Homo sapiens
  misc_feature (1561)..(1561): n is a, c, g, or t
  misc_feature (1602)..(1602): n is a, c, g, or t
  misc_feature (1605)..(1605): n is a, c, g, or t
  misc_feature (1613)..(1613): n is a, c, g, or t
  misc_feature (1615)..(1615): n is a, c, g, or t
  misc_feature (1621)..(1621): n is a, c, g, or t
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaaaaaaaaaaaaaaaaaaaaaaactttgttgggcgccctgggcccctgaaaaanttttttaaaccccttccgttgtggggccgcgcgggcccccngtngggttacngnggaacncgttggcacaaggaggggtcccaagagggagacccgcggcaggagcaaagggcggagttctccaccaaataaaaaaaggcgcggggggaacacgcggcgtttctgaacaacacccgaagaggggagtcacgaggcacacacgcggctctatcaacgggagcccacgggtcacggaaatatgca

SEQ ID NO: 307980 - DNA, 2056 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaaaaaacacaacacagcaccaaccagcacacgacacacatacgcaccacacagacgaggggggcgcatcaacgacccccacgagaggcccacacactccagcgacaacaagctctctaaaacgagagccccacatgagacaccacataaaccacaaccggcgacaccttaaacaacgcgacgatgcgggaaacacacgtacgccgcgacacccggagcagaagacccacaccccgggcgcggcgccacacatgggcgcaccccccccgcaagcattacgcgcccaggggcctataacacccacagggtgctatcgtgtggcccacccccatgctagtgcgcgacacaaataccgcagctaatgcttaaaatcccgcccaccgctaggcaacgcaaccaccgcagcacagtgcgcatcgtgagccgcgaagcgtcgctagagcccggtcaggcagtgactagcaatgcctcgcttcgccatgcatcgatcgcacagtataattacatcatcagacgtgcagccagcgatcgaggtcgataatgatcagtt

SEQ ID NO: 307981 - DNA, 2133 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaagagaagggggggggcgggcgagatttctttctcgccgggggggcggctacaatgagcgccaaccagaacgtctatgatgagaaaaaggggcagcaccaataatagagagaaaataaatatagacaagcgaagcagggacagcaaaaaaaaaacagagagaagagaggaaacaacagccaccagagagagacatatgaaggagaaaagaaacaccacatatatcaggaggggggggcgcacacaataatcaggacggaggggaaaaaaacacacgagtagaaggagagataaatatataaagtaacatgcgaatggggagtaaagaaataaataataataatagattaatgagaagataagaggatatattattaagaggtggattacacacacaaaacaacggaacgttgtagtaacattgtaggttgtggagcaatctagaagaaagaaactatgttgcgcagcgcacatgagaaggagaatgaatttaattaaataaagagaaattttttataatagcgggg

SEQ ID NO: 307982 - DNA, 2169 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaaaaaaaaaaaaaaaaaaaaaaaaaaaacaaaacaacaaaaaaaaaaaaaaaacaaaaaaaaaaaaaaaaaaaaaaaaaaaaaaaaaaaaaaaaaaaaaaaaaaaaaaaaaaaaaaaaaacaaaaaaaaaaaaaaaaagagaagggggggggcgggcgagatttctttctcgccgggggggcggctacaatgagcgccaaccagaacgtctatgatgagaaaaaggggcagcaccaataatagagagaaaataaatatagacaagcgaagcagggacagcaaaaaaaaaacagagagaagagaggaaacaacagccaccagagagagacatatgaaggagaaaagaaacaccacatatatcaggaggggggggcgcacacaataatcaggacggaggggaaaaaaacacacgagtagaaggagagataaatatataaagtaacatgcgaatggggagtaaagaaataaataataataatagattaatgagaagataagaggatatattattaagaggtggattacacacacaaaacaacggaacgttgtagtaacattgtaggttgtggagcaatctagaagaaagaaactatgttgcgcagcgcacatgagaaggagaatgaatttaattaaataaagagaaattttttataatagcgggg

SEQ ID NO: 307983 - DNA, 1562 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaaaaaaaaagtcgacgcgaccgcgaatttagtagtagtaggcggccgactctaga

SEQ ID NO: 307984 - DNA, 2112 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaaaaaaaaaaaaaaaaaaaaaaaaaaaaaaaaaaaaaaaaaaaaaaaaaaaaaaaaaaaaaaacaaaaaaaaaaaaaaaaagagaagggggggggcgggcgagatttctttctcgccgggggggcggctacaatgagcgccaaccagaacgtctatgatgagaaaaaggggcagcaccaataatagagagaaaataaatatagacaagcgaagcagggacagcaaaaaaaaaacagagagaagagaggaaacaacagccaccagagagagacatatgaaggagaaaagaaacaccacatatatcaggaggggggggcgcacacaataatcaggacggaggggaaaaaaacacacgagtagaaggagagataaatatataaagtaacatgcgaatggggagtaaagaaataaataataataatagattaatgagaagataagaggatatattattaagaggtggattacacacacaaaacaacggaacgttgtagtaacattgtaggttgtggagcaatctagaagaaagaaactatgttgcgcagcgcacatgagaaggagaatgaatttaattaaataaagagaaattttttataatagcgggg

SEQ ID NO: 307985 - DNA, 1833 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaaaaaagaacgacaacaaagcgacaaagaagcacatacaaacaccgcaccaagcgcaacaaacacaacaaacgaacacaaacaaccagacaagaaaaaagagccggcgacccaagcaataccccgcgggacagcaacaacagagaaccacacacttgcagagaaaggccccacgacagcagtcaacaacacaccgcggccgactacacaacagtagcagcaagacgccggtcacacaaggggacaccagggggtggcagaaacgagccaacaaacgcgaaggacgagcaaacaaatgcgaccaccaactgcgagaatgcagaacat

SEQ ID NO: 307986 - DNA, 1547 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaaaaatgatgatgcggccagattcctcacagtaaatagatattgtactaataatcaccttt

SEQ ID NO: 307987 - DNA, 1516 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagctagtgttcatatggaagggtactctagagtcgctctgcgcctgatacgat

SEQ ID NO: 307988 - DNA, 1413 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctattatacagagttatagtcgacgcggccgcgaat

SEQ ID NO: 307989 - DNA, 1373 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaatacagcattaggtagggacgactcaatcg

SEQ ID NO: 307990 - DNA, 3418 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaagtatgtaccattctacttatatgtcctgcttagaggaagaattatttgtagaaagaacagaaaacctcatgttgtttgaaaatctcacatttaatatcttcccattaatgagaatcattgttctatttgatgaaagaggtaatacactaccttctcagaataaacttctgttagattcggtgcctttttttacagatgagattgtaaagtgagcctgtaagtgatttacggctcacttgtgatttgcttaaaacatgtgtcaccacgggaagggtgatgtactttcttttttaacgtgtaattttagtggcctacttcctctaaggttgtgagttttataatctcccactttatgagtctgatttgttgtttttattattctgtcttttatgccacagattaatagttgaaacttttgaaatgtcattctatgattaaggatgtagaatgatgtatttgagatcaactatgtcactttaactttactgtctgacatgcatggtattatacaaggtacctcttctattctgacattttgagcccacaaatgaatagttatgaaattatcttccttttttctttgcagctccaaaataaggaggttttcagagagagagagaaagaaagatctaactatttgaataatatgaaggaatattttgaatatatatgaataatttgaataatatgaaatgatagacatgctaggtactgctctgtagtggttagcatagttgctgccccctttctgccatagtctagtgtgatatttcgttgggtaatgatgaatacctggtgccatggaagagaaaagtgggacatatactccagactttggaaatccaggtagcattgctgtcagctaaattaacacctgaagtttaaatagaaatgagccagatgagggcaagagtggaagagatggggataaagcaagggtggtccaagaggaagaagtaacccacacacaggcttgaaggcaaaaggtaacataaccttctcaagacagtaagtatagagtgatggtgcacactggaagagatggtagaattaggcaggatattgtaagccttgaaaaagaattaggcaggatatcggaagccctgattagattctatcctaagagcaacagaagatcactgacagtgttttaaatagatagactagtttattagatttgcagtttagaagttccctttttttgtaattattggacagtgtagagaccggatggtgagagatgagttaggaagttgtgacagctctctatacctaccgctaatgtagaggattatttattttcatttcattaccattcgtgtaaggtgtgtgtgtgtgtgtgtgtgtgtgtgtgtgtgtgtgtatagctagtttctctatagaaattatatggaagagtaagaaggcttcactttaaaattcatgtttttaatgagagtattttctgaatatgagacacttaccctcatttattttggccagggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaaaacaccacacaacacaacgaaacacagaaaacaaaacaaaagaaaggacgaaagaaaaacaaaacaacccacagaggagacaaggaaagaaaaccaccagaacagaagcagacgagacaacaaagaagaggaaaaaagagaaaagaccggacgagaacacccgagcagatgacaaagactcaagagacaaagagagaaaaacaactaatgcaggggaaggagaaaggagaaaacaaaagagataaacgaacacagaaaaacaacaacggccgcagagaaaaagaacatacaagaaagaaactaagaaagagaagaatagacaagaaagacaagaaaacagaaagaaagaaacaaaatcgagacaacgaaaacacgaagaagcccgaaagaagaacaagaagcaagcgacagacaagccaagcagagc

SEQ ID NO: 307991 - DNA, 1448 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagcaagcgtcgcgcatgcgcgacgcttccatcaaactcatactcgtccttaccgggggccgtggccttctgtggctctgggttcttggccttgtgcttgaggcctttttcgaactcggagtccgtgttgttgccgtcgactgaactggaaggtgcgaaggatggtgcgtcttcctcttctgagctctccgtcgagctctcctcgc

SEQ ID NO: 307992 - DNA, 1212 bp, Homo sapiens
  misc_feature (1175)..(1175): n is a, c, g, or t
  misc_feature (1189)..(1189): n is a, c, g, or t
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaccnaagggggttttggncctgggggttcttttgggggggt

SEQ ID NO: 307993 - DNA, 1255 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggtatgttttgattcctctaatgccatcccaacaaatgaaagttctttttgcaagatcttcaaggagaagagttgacttattgtatctat

SEQ ID NO: 307994 - DNA, 2895 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaagtatgtaccattctacttatatgtcctgcttagaggaagaattatttgtagaaagaacagaaaacctcatgttgtttgaaaatctcacatttaatatcttcccattaatgagaatcattgttctatttgatgaaagaggtaatacactaccttctcagaataaacttctgttagattcggtgcctttttttacagatgagattgtaaagtgagcctgtaagtgatttacggctcacttgtgatttgcttaaaacatgtgtcaccacgggaagggtgatgtactttcttttttaacgtgtaattttagtggcctacttcctctaaggttgtgagttttataatctcccactttatgagtctgatttgttgtttttattattctgtcttttatgccacagattaatagttgaaacttttgaaatgtcattctatgattaaggatgtagaatgatgtatttgagatcaactatgtcactttaactttactgtctgacatgcatggtattatacaaggtacctcttctattctgacattttgagcccacaaatgaatagttatgaaattatcttccttttttctttgcagctccaaaataaggaggttttcagagagagagagaaagaaagatctaactatttgaataatatgaaggaatattttgaatatatatgaataatttgaataatatgaaatgatagacatgctaggtactgctctgtagtggttagcatagttgctgccccctttctgccatagtctagtgtgatatttcgttgggtaatgatgaatacctggtgccatggaagagaaaagtgggacatatactccagactttggaaatccaggtagcattgctgtcagctaaattaacacctgaagtttaaatagaaatgagccagatgagggcaagagtggaagagatggggataaagcaagggtggtccaagaggaagaagtaacccacacacaggcttgaaggcaaaaggtaacataaccttctcaagacagtaagtatagagtgatggtgcacactggaagagatggtagaattaggcaggatattgtaagccttgaaaaagaattaggcaggatatcggaagccctgattagattctatcctaagagcaacagaagatcactgacagtgttttaaatagatagactagtttattagatttgcagtttagaagttccctttttttgtaattattggacagtgtagagaccggatggtgagagatgagttaggaagttgtgacagctctctatacctaccgctaatgtagaggattatttattttcatttcattaccattcgtgtaaggtgtgtgtgtgtgtgtgtgtgtgtgtgtgtgtgtgtgtatagctagtttctctatagaaattatatggaagagtaagaaggcttcactttaaaattcatgtttttaatgagagtattttctgaatatgagacacttaccctcatttattttggccagggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctattatacagagttatagtcgacgcggccgcgaat

SEQ ID NO: 307995 - DNA, 1080 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcggtatgtagtccagcagttgaaagagttttctaactagaaattgtattttcaaagctatcctatacttaacaagaacaacagcaacaaaaccaataa

SEQ ID NO: 307996 - DNA, 4540 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaaggtaagtcttggttttccttttagttagttttggttgttttgaaaacttttctcatcactatgttaaatgttactgcttctacaggatttatggttagttgcatttaacatgataagtcattcataaatctttctgtagaattacattggatatttatattttaggaatcacaaattacaatatttttgttctacttagttaacaaatacaagtaaaaataagataagtttgcttaatactggctcattgtactcttggtaagttaccatgagaaagaagggaagaatgtgctttccctctggtagccttaaaagaatgtgtttttcctttccttccccttgaaatatttcttcccaagagctgtgtgttttacagagaaatcgtgatgggggctgctttttgggggcaagaacaaaagtgataggagtgggctgcagggaactgtttcaaaatagtaggactttcataatttattttcttcttttgtaaggaaaacaagatagattcagacctcaaagtgctaatcatgctctttgtaataaacatttaaaaatatatgttatatttgcttatgctatttttccttttcttgtaggctctgtgtcatatacagtcttttcaagtgctggctggaaaacctaaaaagaagggaaatactttctgggtagtgtcagatacattatcctaggggaatgtcagtgaggccctccaacagctattccacttgattgttgcatgagctaatggccataaaactccttagaaaagcacaaagcaaaactaaagaagagtatttactagtgttggatatatttgtaaaagtgagattacaaatcatgtatctggctatttttttcttaaacatgttccttcaagaatttttctgttcgttcattttaaatatttattaaatgttctgatttcttatgttcactgctagctaattaacaaggatggaatttttcttgccttggttatatctaaaagattgtaaaaactttgagaaagcaatgttgccctctttccacaggagtattttggtagctgtaagagaatgcacattgcaaatgactcaaatgtggtaaaatgttggtttcataattctgaaatggcctcttccccaaaagtgacagtaacaccctagctccaggctcaaccacatccagcacatagccaacatttaacagatgttgacaaaatagttaataataatattattaaggaaccagccagagtttcatgcttattaaatactttttcaaccagaaggtctgcaaaggttgatttctgaatatgacgttagctctctctagacctattaatttacgacatttcaaatcagaggtaaaccagcagacctattatttttcaatgataaactataaacagttttttgaagtcaactatttccttttcctttaaaattggacagaatttcatcaggaagctcagaacaatccaatttatataatgccttccttcattatgctaattttcttcatcttcatctacttgaagtaatatttaagattggcacttcagagctgtaaatggatcttagatgataattacttcaacattcttattttataaacgaagaccctctggagaagctaaatgtttttcttgaggtcagatcgccagataatcaagaaccagtatacttcaatttgtattttatatcctatagttgtgggtagaaaatgttcattaaattagtgtagatatgttttttaaaatattagcaatgatacatgatattcattcaataatacttattaacatcctaaattccaggcattttgctagggattggaagtacatacataatgaatattattatttgtatgttagcacgggcctcatggcctgctcctggggaatataaacaagccaatggaaagtgataatacagaaaggtggggctggtgtaggggtgaagtcaggatgctttgggagagcatggaaggtcaccgaatccagtgctgaggaactaatgaagggtttctgaagaacgtgatgagatcaatgctgatgagtcacttagaagtagcaattagttaggcaaagggaagtgaatgtggaggaggaacaagcattccaggcaagaagaacaccctatcgaaaagcctggaagcaaaacattagtgaggctacctttcataaattgctttctgtaagtcatgccattgtgtagtcttaattgctttctctcaccagggaaggtgtgggaaggacttgtgaaatacatattcgaggaaaaactatgcacaaggccgtgcatttaaaaataaactccctaaggctggggtgaaacctgctacggtctgcgcaagttgactgttaatgaatttgattctcaggtgtgagtgattaaaagaacactgatcatgtcattttctttttggtcactaattccctccctcccttctctttcttttcttttttcttttcttttctttttctttctttcttcccgacagagtcttgttatgtcgcccaggatggagtgtagtggtacaatctcggctcactgcagcctccgcctcttcctgggttcaagtgattctcctgcctcagccttctgagtagatgggactacagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaaaacaccacacaacacaacgaaacacagaaaacaaaacaaaagaaaggacgaaagaaaaacaaaacaacccacagaggagacaaggaaagaaaaccaccagaacagaagcagacgagacaacaaagaagaggaaaaaagagaaaagaccggacgagaacacccgagcagatgacaaagactcaagagacaaagagagaaaaacaactaatgcaggggaaggagaaaggagaaaacaaaagagataaacgaacacagaaaaacaacaacggccgcagagaaaaagaacatacaagaaagaaactaagaaagagaagaatagacaagaaagacaagaaaacagaaagaaagaaacaaaatcgagacaacgaaaacacgaagaagcccgaaagaagaacaagaagcaagcgacagacaagccaagcagagc

SEQ ID NO: 307997 - DNA, 2057 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagagtcttgttatgtcgcccaggatggagtgtagtggtacaatctcggctcactgcagcctccgcctcttcctgggttcaagtgattctcctgcctcagccttctgagtagatgggactacagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaaaacaccacacaacacaacgaaacacagaaaacaaaacaaaagaaaggacgaaagaaaaacaaaacaacccacagaggagacaaggaaagaaaaccaccagaacagaagcagacgagacaacaaagaagaggaaaaaagagaaaagaccggacgagaacacccgagcagatgacaaagactcaagagacaaagagagaaaaacaactaatgcaggggaaggagaaaggagaaaacaaaagagataaacgaacacagaaaaacaacaacggccgcagagaaaaagaacatacaagaaagaaactaagaaagagaagaatagacaagaaagacaagaaaacagaaagaaagaaacaaaatcgagacaacgaaaacacgaagaagcccgaaagaagaacaagaagcaagcgacagacaagccaagcagagc

SEQ ID NO: 307998 - DNA, 1819 bp, Homo sapiens
cgactctagaggtcccccattcgcggattcaccaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaaaacaccacacaacacaacgaaacacagaaaacaaaacaaaagaaaggacgaaagaaaaacaaaacaacccacagaggagacaaggaaagaaaaccaccagaacagaagcagacgagacaacaaagaagaggaaaaaagagaaaagaccggacgagaacacccgagcagatgacaaagactcaagagacaaagagagaaaaacaactaatgcaggggaaggagaaaggagaaaacaaaagagataaacgaacacagaaaaacaacaacggccgcagagaaaaagaacatacaagaaagaaactaagaaagagaagaatagacaagaaagacaagaaaacagaaagaaagaaacaaaatcgagacaacgaaaacacgaagaagcccgaaagaagaacaagaagcaagcgacagacaagccaagcagagc

SEQ ID NO: 307999 - DNA, 2081 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagggaaggtgtgggaaggacttgtgaaatacatattcgaggaaaaactatgcacaaggccgtgcatttaaaaataaactccctaaggctggggtgaaacctgctacggtctgcgcaagttgactgttaatgaatttgattctcaggtacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaaaacaccacacaacacaacgaaacacagaaaacaaaacaaaagaaaggacgaaagaaaaacaaaacaacccacagaggagacaaggaaagaaaaccaccagaacagaagcagacgagacaacaaagaagaggaaaaaagagaaaagaccggacgagaacacccgagcagatgacaaagactcaagagacaaagagagaaaaacaactaatgcaggggaaggagaaaggagaaaacaaaagagataaacgaacacagaaaaacaacaacggccgcagagaaaaagaacatacaagaaagaaactaagaaagagaagaatagacaagaaagacaagaaaacagaaagaaagaaacaaaatcgagacaacgaaaacacgaagaagcccgaaagaagaacaagaagcaagcgacagacaagccaagcagagc

SEQ ID NO: 308000 - DNA, 2883 bp, Homo sapiens
actttgggaggccgaggcgggcagatcacttggggtcatgagttcaaaatcagcctagccaacatggtgaaaacctgtctctactaaaaatacaaaaattagccgggcgtggtggctggtgcctgtaatcccagctactcaggaggctgaggcaggagaattgcttgaacccaggagacggaggttgcagtgagtcgagatttcaccactgcactccagcctgggcgacagagaaagactccatctcaaaaaaaaaaaaaaaaaaaaaagcaatcattaagcttttcatctagccattacttttgtacaggctctcattaattccacatagatggtctaatggtctactaaatagtattctaatcctccatcttgtctatctcttagccattctccatgataaaggatgaatggtctttcggaaacataaatgaaaccatgctgctttaaaaaaacaaacaaacaaaaagaaacccattaatgttttcccaaagctttgtggacacattgaagcttcttgtttcagcttctgccaacatttctcgctccagcaaactttcttctgcttcccaaatatgacaagcttcttctttaacttttctgccaggttaatcttgactcatttcaagagaggcttgggtcagccagggcctactctaagaagtttctttagcccttatgttttcctatggagagcacacactagctttaagtcctgagggtacttaagatgatatttcaatgtttttgtactcttagtgcttggcatatggtgggtggtctacaaatttagaacaatgtagtgaaccacaaactcctctcttcagcctgtgtgcttacttgtagtagttgtctgatctctaaaatttagaactgaatatgccaagaaagagttcaatttcagagaggagggtatggtttcattttaagtataaaagcttcctttaaaaaaaattacgtcttacattttgttatgctcctaagtgtaattgatcctggaaagtaagcgcaaggctactctctaatgctaactcttatgtatgtaagaggtgaggaaggagaggttgtgtgtggtgcatttgttttgtaaaagcatctaactgttttctttccagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaaaacaccacacaacacaacgaaacacagaaaacaaaacaaaagaaaggacgaaagaaaaacaaaacaacccacagaggagacaaggaaagaaaaccaccagaacagaagcagacgagacaacaaagaagaggaaaaaagagaaaagaccggacgagaacacccgagcagatgacaaagactcaagagacaaagagagaaaaacaactaatgcaggggaaggagaaaggagaaaacaaaagagataaacgaacacagaaaaacaacaacggccgcagagaaaaagaacatacaagaaagaaactaagaaagagaagaatagacaagaaagacaagaaaacagaaagaaagaaacaaaatcgagacaacgaaaacacgaagaagcccgaaagaagaacaagaagcaagcgacagacaagccaagcagagc

SEQ ID NO: 308001 - DNA, 1747 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaaaacaccacacaacacaacgaaacacagaaaacaaaacaaaagaaaggacgaaagaaaaacaaaacaacccacagaggagacaaggaaagaaaaccaccagaacagaagcagacgagacaacaaagaagaggaaaaaagagaaaagaccggacgagaacacccgagcagatgacaaagactcaagagacaaagagagaaaaacaactaatgcaggggaaggagaaaggagaaaacaaaagagataaacgaacacagaaaaacaacaacggccgcagagaaaaagaacatacaagaaagaaactaagaaagagaagaatagacaagaaagacaagaaaacagaaagaaagaaacaaaatcgagacaacgaaaacacgaagaagcccgaaagaagaacaagaagcaagcgacagacaagccaagcagagc

SEQ ID NO: 308002 - DNA, 1799 bp, Homo sapiens
  misc_feature (84)..(84): n is a, c, g, or t
gagtgtgaaatcttcagaagaaagaaattttctcctttagcttctttggccaagcaaagcgtagagcattaaacgaccaccctntcaaatgcagtatcagatctcagcagctggttatgaaatgagagcagattgtcaacgtgagtctcaagtgtcgcgatcagcgtgagcctatctactcatcatctcggatgtcgctgctgcataggcatatgttaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaaaacaccacacaacacaacgaaacacagaaaacaaaacaaaagaaaggacgaaagaaaaacaaaacaacccacagaggagacaaggaaagaaaaccaccagaacagaagcagacgagacaacaaagaagaggaaaaaagagaaaagaccggacgagaacacccgagcagatgacaaagactcaagagacaaagagagaaaaacaactaatgcaggggaaggagaaaggagaaaacaaaagagataaacgaacacagaaaaacaacaacggccgcagagaaaaagaacatacaagaaagaaactaagaaagagaagaatagacaagaaagacaagaaaacagaaagaaagaaacaaaatcgagacaacgaaaacacgaagaagcccgaaagaagaacaagaagcaagcgacagacaagccaagcagagc

SEQ ID NO: 308003 - DNA, 1558 bp, Homo sapiens
ctctggatgcaaagtgtcctctggatgcaaagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaaaacaccacacaacacaacgaaacacagaaaacaaaacaaaagaaaggacgaaagaaaaacaaaacaacccacagaggagacaaggaaagaaaaccaccagaacagaagcagacgagacaacaaagaagaggaaaaaagagaaaagaccggacgagaacacccgagcagatgacaaagactcaagagacaaagagagaaaaacaactaatgcaggggaaggagaaaggagaaaacaaaagagataaacgaacacagaaaaacaacaacggccgcagagaaaaagaacatacaagaaagaaactaagaaagagaagaatagacaagaaagacaagaaaacagaaagaaagaaacaaaatcgagacaacgaaaacacgaagaagcccgaaagaagaacaagaagcaagcgacagacaagccaagcagagc

SEQ ID NO: 308004 - DNA, 1219 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagaggtaacaataaatttctttttctggaatctgtttatggaagatgcaattttcttttttgatgacaaataagagaaagtaaaaacagaaccctttttcaatatcactcctgtatcaaacagatacagtgttcctgacccattgttatttgtcaatttgtccaattttgtacagccgctactttatcatatttaatacattttgtgacttgggcatgtggaacataattttgttattttcactgcttttactcccctaaaagatttggaatatgtgtgggaaaagacatgcataacagaacaaatgaaattagaatgaagaaaaacaaaaaaaa

SEQ ID NO: 308005 - DNA, 1010 bp, Homo sapiens
  misc_feature (899)..(899): n is a, c, g, or t
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagcatgcctatgacntgggtatatacccagagcaacacaaacattctaccataaagacacatgcactcgaatatttgttgcgcctgttcacatagcaagacccccaaaggggtcctctggcgcccg

SEQ ID NO: 308006 - DNA, 1885 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaaaacaccacacaacacaacgaaacacagaaaacaaaacaaaagaaaggacgaaagaaaaacaaaacaacccacagaggagacaaggaaagaaaaccaccagaacagaagcagacgagacaacaaagaagaggaaaaaagagaaaagaccggacgagaacacccgagcagatgacaaagactcaagagacaaagagagaaaaacaactaatgcaggggaaggagaaaggagaaaacaaaagagataaacgaacacagaaaaacaacaacggccgcagagaaaaagaacatacaagaaagaaactaagaaagagaagaatagacaagaaagacaagaaaacagaaagaaagaaacaaaatcgagacaacgaaaacacgaagaagcccgaaagaagaacaagaagcaagcgacagacaagccaagcagagc

SEQ ID NO: 308007 - DNA, 1299 bp, Homo sapiens
ccaggagccacaccaagagccccacgaagagccgcacgacgagcctcgcaaagtgccacacgaagagccgcaccaggaccacaccaagagcggctcatggggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaaaacaccacacaacacaacgaaacacagaaaacaaaacaaaagaaaggacgaaagaaaaacaaaacaacccacagaggagacaaggaaagaaaaccaccagaacagaagcagacgagacaacaaagaagaggaaaaaagagaaaagaccggacgagaacacccgagcagatgacaaagactcaagagacaaagagagaaaaacaactaatgcaggggaaggagaaaggagaaaacaaaagagataaacgaacacagaaaaacaacaacggccgcagagaaaaagaacatacaagaaagaaactaagaaagagaagaatagacaagaaagacaagaaaacagaaagaaagaaacaaaatcgagacaacgaaaacacgaagaagcccgaaagaagaacaagaagcaagcgacagacaagccaagcagagc

SEQ ID NO: 308008 - DNA, 1540 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaaggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaaaacaccacacaacacaacgaaacacagaaaacaaaacaaaagaaaggacgaaagaaaaacaaaacaacccacagaggagacaaggaaagaaaaccaccagaacagaagcagacgagacaacaaagaagaggaaaaaagagaaaagaccggacgagaacacccgagcagatgacaaagactcaagagacaaagagagaaaaacaactaatgcaggggaaggagaaaggagaaaacaaaagagataaacgaacacagaaaaacaacaacggccgcagagaaaaagaacatacaagaaagaaactaagaaagagaagaatagacaagaaagacaagaaaacagaaagaaagaaacaaaatcgagacaacgaaaacacgaagaagcccgaaagaagaacaagaagcaagcgacagacaagccaagcagagc

SEQ ID NO: 308009 - DNA, 1507 bp, Homo sapiens
gagtgcaagatttagctctgggcctcttggaagtgaaggcgatggaaaagttatgacaattaccaaagttcaccatcttataatagtatactgatttctactgttaaatgtaagagaaatttagtgcacaggtctttatataagggaagatccatttgctgtggctcttagaactgctgtaggaagtgctatagttgtcaatcacatgccgtttctaataactgtcaacatttgcaaacatttcgccaaaatatataggaataccaaaatggccaggtaagttacattcctaggagaggatgaagtattcacgttatgattaattgggtatattgctttaaaaggtgtagccaaagttgttattctaaaaaattctttgagtcagttgccttgattttgctaaagctttctaaagaaaaggatgttttgcatgtatcttagtttgaatttaatattcagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaaaacaccacacaacacaacgaaacacagaaaacaaaacaaaagaaaggacgaaagaaaaacaaaacaacccacagaggagacaaggaaagaaaaccaccagaacagaagcagacgagacaacaaagaagaggaaaaaagagaaaagaccggacgagaacacccgagcagatgacaaagactcaagagacaaagagagaaaaacaactaatgcaggggaaggagaaaggagaaaacaaaagagataaacgaacacagaaaaacaacaacggccgcagagaaaaagaacatacaagaaagaaactaagaaagagaagaatagacaagaaagacaagaaaacagaaagaaagaaacaaaatcgagacaacgaaaacacgaagaagcccgaaagaagaacaagaagcaagcgacagacaagccaagcagagc

SEQ ID NO: 308010 - DNA, 1056 bp, Homo sapiens
  misc_feature (796)..(796): n is a, c, g, or t
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccaggcnttgtatgaagcaaaagaaagttgctgaggaaaagagtgaaaggaagactgaaaaatcacctcagaatgatgccaaagaaaaagtagctcttggatcctgacgggggcagatgatcctgaagggggcagatctttctacttttatgacaagagccatgtttcttgtccaattctctatggaattctctttatttgaatcattgctttaaaaaatattgtctccaaattgatgttgtattaaagttgtctaagttgttgaac

SEQ ID NO: 308011 - DNA, 1500 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggtaaggaagtgcttacaaaatactgctgcagttcatcttcctaccttaagtggggctaccacatgatcccctgtgaaagcaaatctaagatcttctgagagaccaatggcttcttaatgttcatttcctgaatgaccatgtctttctgtagcccccacacacaaaaaagtagtctttgtaagttttcaatatctctcattattcgtaaaaccagagagaactgaagaaggacaatacaaatttgatttgtcattcccaagaattgtttgttaaaaaaaactctgacctttcgttgtactaggtataagaaggggaaatgtaatttttttattatgtgcaatggaaagagtaagcatatttaacgttatttttaacagagaactttggaatggtttatagatgtcaatttatattgtcaaaatattactgcaatgatataacaagagtataggataaattataataatatatgctttctaacatattgttttatttagtttcagtgacattgctgattatttatatgccaaaccactggcaacataagaaaaatcatatcattttaaagcctggaatttccatttctagagaattcattacagtgcttcactaaggatagagatttctttgtgcacccccatccacttctgctataccagtacattatcatgtacataataggcactcatgaactttttgttcaaca

SEQ ID NO: 308012 - DNA, 828 bp, Homo sapiens
  misc_feature (796)..(796): n is a, c, g, or t
  misc_feature (804)..(804): n is a, c, g, or t
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccaggcntgtatgangcagcagtgtcaaggcagtgttct

SEQ ID NO: 308013 - DNA, 4068 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaaggtaagtcttggttttccttttagttagttttggttgttttgaaaacttttctcatcactatgttaaatgttactgcttctacaggatttatggttagttgcatttaacatgataagtcattcataaatctttctgtagaattacattggatatttatattttaggaatcacaaattacaatatttttgttctacttagttaacaaatacaagtaaaaataagataagtttgcttaatactggctcattgtactcttggtaagttaccatgagaaagaagggaagaatgtgctttccctctggtagccttaaaagaatgtgtttttcctttccttccccttgaaatatttcttcccaagagctgtgtgttttacagagaaatcgtgatgggggctgctttttgggggcaagaacaaaagtgataggagtgggctgcagggaactgtttcaaaatagtaggactttcataatttattttcttcttttgtaaggaaaacaagatagattcagacctcaaagtgctaatcatgctctttgtaataaacatttaaaaatatatgttatatttgcttatgctatttttccttttcttgtaggctctgtgtcatatacagtcttttcaagtgctggctggaaaacctaaaaagaagggaaatactttctgggtagtgtcagatacattatcctaggggaatgtcagtgaggccctccaacagctattccacttgattgttgcatgagctaatggccataaaactccttagaaaagcacaaagcaaaactaaagaagagtatttactagtgttggatatatttgtaaaagtgagattacaaatcatgtatctggctatttttttcttaaacatgttccttcaagaatttttctgttcgttcattttaaatatttattaaatgttctgatttcttatgttcactgctagctaattaacaaggatggaatttttcttgccttggttatatctaaaagattgtaaaaactttgagaaagcaatgttgccctctttccacaggagtattttggtagctgtaagagaatgcacattgcaaatgactcaaatgtggtaaaatgttggtttcataattctgaaatggcctcttccccaaaagtgacagtaacaccctagctccaggctcaaccacatccagcacatagccaacatttaacagatgttgacaaaatagttaataataatattattaaggaaccagccagagtttcatgcttattaaatactttttcaaccagaaggtctgcaaaggttgatttctgaatatgacgttagctctctctagacctattaatttacgacatttcaaatcagaggtaaaccagcagacctattatttttcaatgataaactataaacagttttttgaagtcaactatttccttttcctttaaaattggacagaatttcatcaggaagctcagaacaatccaatttatataatgccttccttcattatgctaattttcttcatcttcatctacttgaagtaatatttaagattggcacttcagagctgtaaatggatcttagatgataattacttcaacattcttattttataaacgaagaccctctggagaagctaaatgtttttcttgaggtcagatcgccagataatcaagaaccagtatacttcaatttgtattttatatcctatagttgtgggtagaaaatgttcattaaattagtgtagatatgttttttaaaatattagcaatgatacatgatattcattcaataatacttattaacatcctaaattccaggcattttgctagggattggaagtacatacataatgaatattattatttgtatgttagcacgggcctcatggcctgctcctggggaatataaacaagccaatggaaagtgataatacagaaaggtggggctggtgtaggggtgaagtcaggatgctttgggagagcatggaaggtcaccgaatccagtgctgaggaactaatgaagggtttctgaagaacgtgatgagatcaatgctgatgagtcacttagaagtagcaattagttaggcaaagggaagtgaatgtggaggaggaacaagcattccaggcaagaagaacaccctatcgaaaagcctggaagcaaaacattagtgaggctacctttcataaattgctttctgtaagtcatgccattgtgtagtcttaattgctttctctcaccagggaaggtgtgggaaggacttgtgaaatacatattcgaggaaaaactatgcacaaggccgtgcatttaaaaataaactccctaaggctggggtgaaacctgctacggtctgcgcaagttgactgttaatgaatttgattctcaggtgtgagtgattaaaagaacactgatcatgtcattttctttttggtcactaattccctccctcccttctctttcttttcttttttcttttcttttctttttctttctttcttcccgacagagtcttgttatgtcgcccaggatggagtgtagtggtacaatctcggctcactgcagcctccgcctcttcctgggttcaagtgattctcctgcctcagccttctgagtagatgggactacagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacaggaaagcccctggatgaaacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaaaacaccacacaacacaacgaaacacagaaaacaaaacaaaagaaaggacgaaagaaaaacaaaacaacccacagaggagacaaggaaagaaaaccaccagaacagaagcagacgagacaacaaagaagaggaaaaaagagaaaagaccggacgagaacacccgagcagatgacaaagactcaagagacaaagagagaaaaacaactaatgcaggggaaggagaaaggagaaaacaaaagagataaacgaacacagaaaaacaacaacggccgcagagaaaaagaacatacaagaaagaaactaagaaagagaagaatagacaagaaagacaagaaaacagaaagaaagaaacaaaatcgagacaacgaaaacacgaagaagcccgaaagaagaacaagaagcaagcgacagacaagccaagcagagc

SEQ ID NO: 308014 - DNA, 4244 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaaggtaagtcttggttttccttttagttagttttggttgttttgaaaacttttctcatcactatgttaaatgttactgcttctacaggatttatggttagttgcatttaacatgataagtcattcataaatctttctgtagaattacattggatatttatattttaggaatcacaaattacaatatttttgttctacttagttaacaaatacaagtaaaaataagataagtttgcttaatactggctcattgtactcttggtaagttaccatgagaaagaagggaagaatgtgctttccctctggtagccttaaaagaatgtgtttttcctttccttccccttgaaatatttcttcccaagagctgtgtgttttacagagaaatcgtgatgggggctgctttttgggggcaagaacaaaagtgataggagtgggctgcagggaactgtttcaaaatagtaggactttcataatttattttcttcttttgtaaggaaaacaagatagattcagacctcaaagtgctaatcatgctctttgtaataaacatttaaaaatatatgttatatttgcttatgctatttttccttttcttgtaggctctgtgtcatatacagtcttttcaagtgctggctggaaaacctaaaaagaagggaaatactttctgggtagtgtcagatacattatcctaggggaatgtcagtgaggccctccaacagctattccacttgattgttgcatgagctaatggccataaaactccttagaaaagcacaaagcaaaactaaagaagagtatttactagtgttggatatatttgtaaaagtgagattacaaatcatgtatctggctatttttttcttaaacatgttccttcaagaatttttctgttcgttcattttaaatatttattaaatgttctgatttcttatgttcactgctagctaattaacaaggatggaatttttcttgccttggttatatctaaaagattgtaaaaactttgagaaagcaatgttgccctctttccacaggagtattttggtagctgtaagagaatgcacattgcaaatgactcaaatgtggtaaaatgttggtttcataattctgaaatggcctcttccccaaaagtgacagtaacaccctagctccaggctcaaccacatccagcacatagccaacatttaacagatgttgacaaaatagttaataataatattattaaggaaccagccagagtttcatgcttattaaatactttttcaaccagaaggtctgcaaaggttgatttctgaatatgacgttagctctctctagacctattaatttacgacatttcaaatcagaggtaaaccagcagacctattatttttcaatgataaactataaacagttttttgaagtcaactatttccttttcctttaaaattggacagaatttcatcaggaagctcagaacaatccaatttatataatgccttccttcattatgctaattttcttcatcttcatctacttgaagtaatatttaagattggcacttcagagctgtaaatggatcttagatgataattacttcaacattcttattttataaacgaagaccctctggagaagctaaatgtttttcttgaggtcagatcgccagataatcaagaaccagtatacttcaatttgtattttatatcctatagttgtgggtagaaaatgttcattaaattagtgtagatatgttttttaaaatattagcaatgatacatgatattcattcaataatacttattaacatcctaaattccaggcattttgctagggattggaagtacatacataatgaatattattatttgtatgttagcacgggcctcatggcctgctcctggggaatataaacaagccaatggaaagtgataatacagaaaggtggggctggtgtaggggtgaagtcaggatgctttgggagagcatggaaggtcaccgaatccagtgctgaggaactaatgaagggtttctgaagaacgtgatgagatcaatgctgatgagtcacttagaagtagcaattagttaggcaaagggaagtgaatgtggaggaggaacaagcattccaggcaagaagaacaccctatcgaaaagcctggaagcaaaacattagtgaggctacctttcataaattgctttctgtaagtcatgccattgtgtagtcttaattgctttctctcaccagggaaggtgtgggaaggacttgtgaaatacatattcgaggaaaaactatgcacaaggccgtgcatttaaaaataaactccctaaggctggggtgaaacctgctacggtctgcgcaagttgactgttaatgaatttgattctcaggtgtgagtgattaaaagaacactgatcatgtcattttctttttggtcactaattccctccctcccttctctttcttttcttttttcttttcttttctttttctttctttcttcccgacagagtcttgttatgtcgcccaggatggagtgtagtggtacaatctcggctcactgcagcctccgcctcttcctgggttcaagtgattctcctgcctcagccttctgagtagatgggactacagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacaggaaagcccctggatgaaacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaaaaaaaaaaaaaaaaaaaaaaaaaaaaaaaaaaaaaaaaaaaaaaaaaaaaaaaaaaaaaaacaaaaaaaaaaaaaaaaagagaagggggggggcgggcgagatttctttctcgccgggggggcggctacaatgagcgccaaccagaacgtctatgatgagaaaaaggggcagcaccaataatagagagaaaataaatatagacaagcgaagcagggacagcaaaaaaaaaacagagagaagagaggaaacaacagccaccagagagagacatatgaaggagaaaagaaacaccacatatatcaggaggggggggcgcacacaataatcaggacggaggggaaaaaaacacacgagtagaaggagagataaatatataaagtaacatgcgaatggggagtaaagaaataaataataataatagattaatgagaagataagaggatatattattaagaggtggattacacacacaaaacaacggaacgttgtagtaacattgtaggttgtggagcaatctagaagaaagaaactatgttgcgcagcgcacatgagaaggagaatgaatttaattaaataaagagaaattttttataatagcgggg

SEQ ID NO: 308015 - DNA, 2910 bp, Homo sapiens
gggtgttctgcactcaggcagtgagcatagtacccaataagtagttttttgaccaatgccccttctctccctgccctctctagtagtctgcagtgtctgttgttcatagggtgttctttttaaatgttcttatagtaacataaataaagtatttacataggcttgaacacctagtggcttctccactcccaaggagaatatatgttggatagcgcaaactactgaagttgctcttgagatgtatttaaggtaataaaaaaattgatcgtcagggaaaagaatattcaaaaccaccatctagagagtcacaaataccttctcagaagttaactgccctatattgggagatgagaggtgaagaatgatgatgagggatagaacactgttggcaaaattctatatttcctgtttctttcatatggatatttcatttttttcatggtaaatacatcaactaaaattttcttctctaacagtgaagtgcgccacaagcaaaccagctttctttgcagagaagcttcatcaagccatgaaagtatgtaccattctacttatatgtcctgcttagaggaagaattatttgtagaaagaacagaaaacctcatgttgtttgaaaatctcacatttaatatcttcccattaatgagaatcattgttctatttgatgaaagaggtaatacactaccttctcagaataaacttctgttagattcggtgcctttttttacagatgagattgtaaagtgagcctgtaagtgatttacggctcacttgtgatttgcttaaaacatgtgtcaccacgggaagggtgatgtactttcttttttaacgtgtaattttagtggcctacttcctctaaggttgtgagttttataatctcccactttatgagtctgatttgttgtttttattattctgtcttttatgccacagattaatagttgaaacttttgaaatgtcattctatgattaaggatgtagaatgatgtatttgagatcaactatgtcactttaactttactgtctgacatgcatggtattatacaaggtacctcttctattctgacattttgagcccacaaatgaatagttatgaaattatcttccttttttctttgcagctccaaaataaggaggttttcagagagagagagaaagaaagatctaactatttgaataatatgaaggaatattttgaatatatatgaataatttgaataatatgaaatgatagacatgctaggtactgctctgtagtggttagcatagttgctgccccctttctgccatagtctagtgtgatatttcgttgggtaatgatgaatacctggtgccatggaagagaaaagtgggacatatactccagactttggaaatccaggtagcattgctgtcagctaaattaacacctgaagtttaaatagaaatgagccagatgagggcaagagtggaagagatggggataaagcaagggtggtccaagaggaagaagtaacccacacacaggcttgaaggcaaaaggtaacataaccttctcaagacagtaagtatagagtgatggtgcacactggaagagatggtagaattaggcaggatattgtaagccttgaaaaagaattaggcaggatatcggaagccctgattagattctatcctaagagcaacagaagatcactgacagtgttttaaatagatagactagtttattagatttgcagtttagaagttccctttttttgtaattattggacagtgtagagaccggatggtgagagatgagttaggaagttgtgacagctctctatacctaccgctaatgtagaggattatttattttcatttcattaccattcgtgtaaggtgtgtgtgtgtgtgtgtgtgtgtgtgtgtgtgtgtgtatagctagtttctctatagaaattatatggaagagtaagaaggcttcactttaaaattcatgtttttaatgagagtattttctgaatatgagacacttaccctcatttattttggccagggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaaaacaccacacaacacaacgaaacacagaaaacaaaacaaaagaaaggacgaaagaaaaacaaaacaacccacagaggagacaaggaaagaaaaccaccagaacagaagcagacgagacaacaaagaagaggaaaaaagagaaaagaccggacgagaacacccgagcagatgacaaagactcaagagacaaagagagaaaaacaactaatgcaggggaaggagaaaggagaaaacaaaagagataaacgaacacagaaaaacaacaacggccgcagagaaaaagaacatacaagaaagaaactaagaaagagaagaatagacaagaaagacaagaaaacagaaagaaagaaacaaaatcgagacaacgaaaacacgaagaagcccgaaagaagaacaagaagcaagcgacagacaagccaagcagagc

SEQ ID NO: 308016 - DNA, 1116 bp, Homo sapiens
  misc_feature (4)..(4): n is a, c, g, or t
  misc_feature (16)..(16): n is a, c, g, or t
  misc_feature (28)..(29): n is a, c, g, or t
  misc_feature (37)..(37): n is a, c, g, or t
  misc_feature (50)..(50): n is a, c, g, or t
  misc_feature (55)..(55): n is a, c, g, or t
  misc_feature (58)..(58): n is a, c, g, or t
  misc_feature (69)..(69): n is a, c, g, or t
  misc_feature (100)..(100): n is a, c, g, or t
  misc_feature (112)..(112): n is a, c, g, or t
  misc_feature (122)..(122): n is a, c, g, or t
gcgngagaaagggganaggcacagcagnnacagcgcncacaccaccttcnccacnagncgcaccccacnactcccgcagcggttcgcgacaccccccccngccccgtgcgcntcgacagaanagtctggcctggagtgaaagtgacatgacacaccctccacagcttcgtgagcgcgccacagcaaaccagctttctgccagagaagctcatcacgcccatgaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaaaacaccacacaacacaacgaaacacagaaaacaaaacaaaagaaaggacgaaagaaaaacaaaacaacccacagaggagacaaggaaagaaaaccaccagaacagaagcagacgagacaacaaagaagaggaaaaaagagaaaagaccggacgagaacacccgagcagatgacaaagactcaagagacaaagagagaaaaacaactaatgcaggggaaggagaaaggagaaaacaaaagagataaacgaacacagaaaaacaacaacggccgcagagaaaaagaacatacaagaaagaaactaagaaagagaagaatagacaagaaagacaagaaaacagaaagaaagaaacaaaatcgagacaacgaaaacacgaagaagcccgaaagaagaacaagaagcaagcgacagacaagccaagcagagc

SEQ ID NO: 308017 - DNA, 1064 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaaggtacaactcagatactttaggaaatgcctcttgttttataaagactaatttcttagtccattttgtgttgctataagggaatatctgaggctaggtaatttttaaagataaaaaggtttatttggctcaggattctgatggctaacaaattcaagtttgggtatctatgtctggtgagagcctcaggctgcttccactcctgacagaagaggaaagggagctggtgtgtgcagagaccacatggcaagaaaggaagcaagagagagaatggggaggtgccagcctcgttaacaaccagctctcgtggttctcatgagcaagaactca

SEQ ID NO: 308018 - DNA, 830 bp, Homo sapiens
  misc_feature (753)..(753): n is a, c, g, or t
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacactttgcatccagagacactttgcatccagagacactttgcatccagagacactttgnatccagagacactttgcatccagagacactttgcatccagaggacactttgcatccagaggggatcctctaggctcg

SEQ ID NO: 308019 - DNA, 717 bp, Homo sapiens
  misc_feature (640)..(640): n is a, c, g, or t
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagactttgnatccagagacactttgcatccagagacactttgcatccagaggacactttgcatccagaggggatcctctaggctcg

SEQ ID NO: 308020 - DNA, 3668 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaaggtaagtcttggttttccttttagttagttttggttgttttgaaaacttttctcatcactatgttaaatgttactgcttctacaggatttatggttagttgcatttaacatgataagtcattcataaatctttctgtagaattacattggatatttatattttaggaatcacaaattacaatatttttgttctacttagttaacaaatacaagtaaaaataagataagtttgcttaatactggctcattgtactcttggtaagttaccatgagaaagaagggaagaatgtgctttccctctggtagccttaaaagaatgtgtttttcctttccttccccttgaaatatttcttcccaagagctgtgtgttttacagagaaatcgtgatgggggctgctttttgggggcaagaacaaaagtgataggagtgggctgcagggaactgtttcaaaatagtaggactttcataatttattttcttcttttgtaaggaaaacaagatagattcagacctcaaagtgctaatcatgctctttgtaataaacatttaaaaatatatgttatatttgcttatgctatttttccttttcttgtaggctctgtgtcatatacagtcttttcaagtgctggctggaaaacctaaaaagaagggaaatactttctgggtagtgtcagatacattatcctaggggaatgtcagtgaggccctccaacagctattccacttgattgttgcatgagctaatggccataaaactccttagaaaagcacaaagcaaaactaaagaagagtatttactagtgttggatatatttgtaaaagtgagattacaaatcatgtatctggctatttttttcttaaacatgttccttcaagaatttttctgttcgttcattttaaatatttattaaatgttctgatttcttatgttcactgctagctaattaacaaggatggaatttttcttgccttggttatatctaaaagattgtaaaaactttgagaaagcaatgttgccctctttccacaggagtattttggtagctgtaagagaatgcacattgcaaatgactcaaatgtggtaaaatgttggtttcataattctgaaatggcctcttccccaaaagtgacagtaacaccctagctccaggctcaaccacatccagcacatagccaacatttaacagatgttgacaaaatagttaataataatattattaaggaaccagccagagtttcatgcttattaaatactttttcaaccagaaggtctgcaaaggttgatttctgaatatgacgttagctctctctagacctattaatttacgacatttcaaatcagaggtaaaccagcagacctattatttttcaatgataaactataaacagttttttgaagtcaactatttccttttcctttaaaattggacagaatttcatcaggaagctcagaacaatccaatttatataatgccttccttcattatgctaattttcttcatcttcatctacttgaagtaatatttaagattggcacttcagagctgtaaatggatcttagatgataattacttcaacattcttattttataaacgaagaccctctggagaagctaaatgtttttcttgaggtcagatcgccagataatcaagaaccagtatacttcaatttgtattttatatcctatagttgtgggtagaaaatgttcattaaattagtgtagatatgttttttaaaatattagcaatgatacatgatattcattcaataatacttattaacatcctaaattccaggcattttgctagggattggaagtacatacataatgaatattattatttgtatgttagcacgggcctcatggcctgctcctggggaatataaacaagccaatggaaagtgataatacagaaaggtggggctggtgtaggggtgaagtcaggatgctttgggagagcatggaaggtcaccgaatccagtgctgaggaactaatgaagggtttctgaagaacgtgatgagatcaatgctgatgagtcacttagaagtagcaattagttaggcaaagggaagtgaatgtggaggaggaacaagcattccaggcaagaagaacaccctatcgaaaagcctggaagcaaaacattagtgaggctacctttcataaattgctttctgtaagtcatgccattgtgtagtcttaattgctttctctcaccagggaaggtgtgggaaggacttgtgaaatacatattcgaggaaaaactatgcacaaggccgtgcatttaaaaataaactccctaaggctggggtgaaacctgctacggtctgcgcaagttgactgttaatgaatttgattctcaggtgtgagtgattaaaagaacactgatcatgtcattttctttttggtcactaattccctccctcccttctctttcttttcttttttcttttcttttctttttctttctttcttcccgacagagtcttgttatgtcgcccaggatggagtgtagtggtacaatctcggctcactgcagcctccgcctcttcctgggttcaagtgattctcctgcctcagccttctgagtagatgggactacagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaaggtacaactcagatactttaggaaatgcctcttgttttataaagactaatttcttagtccattttgtgttgctataagggaatatctgaggctaggtaatttttaaagataaaaaggtttatttggctcaggattctgatggctaacaaattcaagtttgggtatctatgtctggtgagagcctcaggctgcttccactcctgacagaagaggaaagggagctggtgtgtgcagagaccacatggcaagaaaggaagcaagagagagaatggggaggtgccagcctcgttaacaaccagctctcgtggttctcatgagcaagaactca

SEQ ID NO: 308021 - DNA, 1131 bp, Homo sapiens
tacaggcactatacatttctcttcttctggtgagtgaatcaggtatctcctcacataagatatgagattatattgtgttatacttatttaattttgtgtgatatttcattcatagaaaataatggcactaatataaaacataattaattcagaaaagtttgtaatctcagtcttgaaggctattgcttttttatgcaatgataaaaaatcagttatctgttgtatatattgtttaattaagtgaatggtaatgtgtaatctcatctacagctaagtctaaaaataattcttctataagtaaaaaaaaatagagaattatggtttcgactaacattaagtatacctttttttgaatcaacaggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaaaacaccacacaacacaacgaaacacagaaaacaaaacaaaagaaaggacgaaagaaaaacaaaacaacccacagaggagacaaggaaagaaaaccaccagaacagaagcagacgagacaacaaagaagaggaaaaaagagaaaagaccggacgagaacacccgagcagatgacaaagactcaagagacaaagagagaaaaacaactaatgcaggggaaggagaaaggagaaaacaaaagagataaacgaacacagaaaaacaacaacggccgcagagaaaaagaacatacaagaaagaaactaagaaagagaagaatagacaagaaagacaagaaaacagaaagaaagaaacaaaatcgagacaacgaaaacacgaagaagcccgaaagaagaacaagaagcaagcgacagacaagccaagcagagc

SEQ ID NO: 308022 - DNA, 3369 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaaggtaagtcttggttttccttttagttagttttggttgttttgaaaacttttctcatcactatgttaaatgttactgcttctacaggatttatggttagttgcatttaacatgataagtcattcataaatctttctgtagaattacattggatatttatattttaggaatcacaaattacaatatttttgttctacttagttaacaaatacaagtaaaaataagataagtttgcttaatactggctcattgtactcttggtaagttaccatgagaaagaagggaagaatgtgctttccctctggtagccttaaaagaatgtgtttttcctttccttccccttgaaatatttcttcccaagagctgtgtgttttacagagaaatcgtgatgggggctgctttttgggggcaagaacaaaagtgataggagtgggctgcagggaactgtttcaaaatagtaggactttcataatttattttcttcttttgtaaggaaaacaagatagattcagacctcaaagtgctaatcatgctctttgtaataaacatttaaaaatatatgttatatttgcttatgctatttttccttttcttgtaggctctgtgtcatatacagtcttttcaagtgctggctggaaaacctaaaaagaagggaaatactttctgggtagtgtcagatacattatcctaggggaatgtcagtgaggccctccaacagctattccacttgattgttgcatgagctaatggccataaaactccttagaaaagcacaaagcaaaactaaagaagagtatttactagtgttggatatatttgtaaaagtgagattacaaatcatgtatctggctatttttttcttaaacatgttccttcaagaatttttctgttcgttcattttaaatatttattaaatgttctgatttcttatgttcactgctagctaattaacaaggatggaatttttcttgccttggttatatctaaaagattgtaaaaactttgagaaagcaatgttgccctctttccacaggagtattttggtagctgtaagagaatgcacattgcaaatgactcaaatgtggtaaaatgttggtttcataattctgaaatggcctcttccccaaaagtgacagtaacaccctagctccaggctcaaccacatccagcacatagccaacatttaacagatgttgacaaaatagttaataataatattattaaggaaccagccagagtttcatgcttattaaatactttttcaaccagaaggtctgcaaaggttgatttctgaatatgacgttagctctctctagacctattaatttacgacatttcaaatcagaggtaaaccagcagacctattatttttcaatgataaactataaacagttttttgaagtcaactatttccttttcctttaaaattggacagaatttcatcaggaagctcagaacaatccaatttatataatgccttccttcattatgctaattttcttcatcttcatctacttgaagtaatatttaagattggcacttcagagctgtaaatggatcttagatgataattacttcaacattcttattttataaacgaagaccctctggagaagctaaatgtttttcttgaggtcagatcgccagataatcaagaaccagtatacttcaatttgtattttatatcctatagttgtgggtagaaaatgttcattaaattagtgtagatatgttttttaaaatattagcaatgatacatgatattcattcaataatacttattaacatcctaaattccaggcattttgctagggattggaagtacatacataatgaatattattatttgtatgttagcacgggcctcatggcctgctcctggggaatataaacaagccaatggaaagtgataatacagaaaggtggggctggtgtaggggtgaagtcaggatgctttgggagagcatggaaggtcaccgaatccagtgctgaggaactaatgaagggtttctgaagaacgtgatgagatcaatgctgatgagtcacttagaagtagcaattagttaggcaaagggaagtgaatgtggaggaggaacaagcattccaggcaagaagaacaccctatcgaaaagcctggaagcaaaacattagtgaggctacctttcataaattgctttctgtaagtcatgccattgtgtagtcttaattgctttctctcaccagggaaggtgtgggaaggacttgtgaaatacatattcgaggaaaaactatgcacaaggccgtgcatttaaaaataaactccctaaggctggggtgaaacctgctacggtctgcgcaagttgactgttaatgaatttgattctcaggtgtgagtgattaaaagaacactgatcatgtcattttctttttggtcactaattccctccctcccttctctttcttttcttttttcttttcttttctttttctttctttcttcccgacagagtcttgttatgtcgcccaggatggagtgtagtggtacaatctcggctcactgcagcctccgcctcttcctgggttcaagtgattctcctgcctcagccttctgagtagatgggactacagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtaacgtgtttcctcaaaacagttccctcctggacatttcagaatggctatttgaatgactgtcaaaaaacagacatgtgcaatggaaagaatctgtttcattttgaagataaaaacatttctttgccaaacgaagatgtaattatttacttaacactgaggaaattgtgttcacatcagtggaatctctattgttacagcagatattactggctcatttctagcagaaattccatgctgaaattaaaagctctgttcacatatagagttgcaactagtatcaaacactgcaacactgagggccaggaaaagttaattgtctcttcctttctcactcgaatgaaatgtcattctcccaagtgcttccttgatatgtagtatagcatcgattttttaggctgatatata

SEQ ID NO: 308023 - DNA, 3769 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaaggtaagtcttggttttccttttagttagttttggttgttttgaaaacttttctcatcactatgttaaatgttactgcttctacaggatttatggttagttgcatttaacatgataagtcattcataaatctttctgtagaattacattggatatttatattttaggaatcacaaattacaatatttttgttctacttagttaacaaatacaagtaaaaataagataagtttgcttaatactggctcattgtactcttggtaagttaccatgagaaagaagggaagaatgtgctttccctctggtagccttaaaagaatgtgtttttcctttccttccccttgaaatatttcttcccaagagctgtgtgttttacagagaaatcgtgatgggggctgctttttgggggcaagaacaaaagtgataggagtgggctgcagggaactgtttcaaaatagtaggactttcataatttattttcttcttttgtaaggaaaacaagatagattcagacctcaaagtgctaatcatgctctttgtaataaacatttaaaaatatatgttatatttgcttatgctatttttccttttcttgtaggctctgtgtcatatacagtcttttcaagtgctggctggaaaacctaaaaagaagggaaatactttctgggtagtgtcagatacattatcctaggggaatgtcagtgaggccctccaacagctattccacttgattgttgcatgagctaatggccataaaactccttagaaaagcacaaagcaaaactaaagaagagtatttactagtgttggatatatttgtaaaagtgagattacaaatcatgtatctggctatttttttcttaaacatgttccttcaagaatttttctgttcgttcattttaaatatttattaaatgttctgatttcttatgttcactgctagctaattaacaaggatggaatttttcttgccttggttatatctaaaagattgtaaaaactttgagaaagcaatgttgccctctttccacaggagtattttggtagctgtaagagaatgcacattgcaaatgactcaaatgtggtaaaatgttggtttcataattctgaaatggcctcttccccaaaagtgacagtaacaccctagctccaggctcaaccacatccagcacatagccaacatttaacagatgttgacaaaatagttaataataatattattaaggaaccagccagagtttcatgcttattaaatactttttcaaccagaaggtctgcaaaggttgatttctgaatatgacgttagctctctctagacctattaatttacgacatttcaaatcagaggtaaaccagcagacctattatttttcaatgataaactataaacagttttttgaagtcaactatttccttttcctttaaaattggacagaatttcatcaggaagctcagaacaatccaatttatataatgccttccttcattatgctaattttcttcatcttcatctacttgaagtaatatttaagattggcacttcagagctgtaaatggatcttagatgataattacttcaacattcttattttataaacgaagaccctctggagaagctaaatgtttttcttgaggtcagatcgccagataatcaagaaccagtatacttcaatttgtattttatatcctatagttgtgggtagaaaatgttcattaaattagtgtagatatgttttttaaaatattagcaatgatacatgatattcattcaataatacttattaacatcctaaattccaggcattttgctagggattggaagtacatacataatgaatattattatttgtatgttagcacgggcctcatggcctgctcctggggaatataaacaagccaatggaaagtgataatacagaaaggtggggctggtgtaggggtgaagtcaggatgctttgggagagcatggaaggtcaccgaatccagtgctgaggaactaatgaagggtttctgaagaacgtgatgagatcaatgctgatgagtcacttagaagtagcaattagttaggcaaagggaagtgaatgtggaggaggaacaagcattccaggcaagaagaacaccctatcgaaaagcctggaagcaaaacattagtgaggctacctttcataaattgctttctgtaagtcatgccattgtgtagtcttaattgctttctctcaccagggaaggtgtgggaaggacttgtgaaatacatattcgaggaaaaactatgcacaaggccgtgcatttaaaaataaactccctaaggctggggtgaaacctgctacggtctgcgcaagttgactgttaatgaatttgattctcaggtgtgagtgattaaaagaacactgatcatgtcattttctttttggtcactaattccctccctcccttctctttcttttcttttttcttttcttttctttttctttctttcttcccgacagagtcttgttatgtcgcccaggatggagtgtagtggtacaatctcggctcactgcagcctccgcctcttcctgggttcaagtgattctcctgcctcagccttctgagtagatgggactacagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagggtaagttagagtggtaaatttagatatttaatttcagcatagttatacttaaccatggattcggaagcacagttacctagttctttaaggttctaaccactgttttctcattacatctatgattgggattgcagtgtttatccactttgttgcaatttaatcaattttatcaaatttcctatttttatacattagtcatcttggtgtatattgtttgcagatgtggtgctctggggacaaatttttaatttgaacgtaaacatcgagattgctgctgtcaataaagaatatggtctgattgaaatgtactaatatttaaactgaactgtttaatgcctaaattttatatataattctactttaaaaataagccttatgtcttttataccaaatatgagtagttttctaaagcaatgaaattagaaaactatataatttcagtatctgattatactgcttgttatttgagaagtacaaacctcaaagattggaaacatgaatatattattttaaaagtaattttacttctgttttctgttagcacacagtcctctgtgttttgatctttgtgatttctcccctgtgtataagattactaaccctatgctttaagaagttattgatgaattcagtaaattttattttaatccctctagatctggaagggtaagataatgtttcaaaatatttggtacactttgtatgtgaaggg

SEQ ID NO: 308024 - DNA, 452 bp, Homo sapiens
  misc_feature (375)..(375): n is a, c, g, or t
ctctggatgcaaagtgtcctctggatgcaaagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacactttgcatccagagacactttgcatccagagacactttgcatccagagacactttgnatccagagacactttgcatccagagacactttgcatccagaggacactttgcatccagaggggatcctctaggctcg

SEQ ID NO: 308025 - DNA, 1165 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagggtaagttagagtggtaaatttagatatttaatttcagcatagttatacttaaccatggattcggaagcacagttacctagttctttaaggttctaaccactgttttctcattacatctatgattgggattgcagtgtttatccactttgttgcaatttaatcaattttatcaaatttcctatttttatacattagtcatcttggtgtatattgtttgcagatgtggtgctctggggacaaatttttaatttgaacgtaaacatcgagattgctgctgtcaataaagaatatggtctgattgaaatgtactaatatttaaactgaactgtttaatgcctaaattttatatataattctactttaaaaataagccttatgtcttttataccaaatatgagtagttttctaaagcaatgaaattagaaaactatataatttcagtatctgattatactgcttgttatttgagaagtacaaacctcaaagattggaaacatgaatatattattttaaaagtaattttacttctgttttctgttagcacacagtcctctgtgttttgatctttgtgatttctcccctgtgtataagattactaaccctatgctttaagaagttattgatgaattcagtaaattttattttaatccctctagatctggaagggtaagataatgtttcaaaatatttggtacactttgtatgtgaaggg

SEQ ID NO: 308026 - DNA, 377 bp, Homo sapiens
caagaacaaaagtgataggagtgggctgcagggaactgtttcaaaatagtaggactttcataatttattttcttcttttgtaaggaaaacaagatagattcagacctcaaagtgctaatcatgctctttgtaataaacatttaaaaatatatgttatatttgcttatgctatttaaaataagaaggtccgcttattacttttttcatttaaagagggtgtggccacattccttttcttgtaggctctgtgtcatatacagtcttttcaagtgctggctggaaaacctaaaaagaagggaaatactttctgggtagtgtcagatacattatcctaggggaatgtcagtgaggccctccaacagctattccacttgatt

SEQ ID NO: 308027 - DNA, 1753 bp, Homo sapiens
ttttttttttttggagttgaaagatgtgagacagtattcagaataatgaagataataataatgattattataataatgatgatgattccaaggaaaaaacctacagcgaatgttccatttctaccccgcacgcagacactctccctaacactgataacctgagcccccagcactggacggaagaatgctggcgtctccgtgtgtactggttcagggttctggccccagccttgtcaggaccccctggtgtccagagcccccacccctcccgcaacaagcagctgatgccccagtgattctctatacatttttcacctcggccaatatgtccaggaaaactgcttacttctcttttcttgcctggagcttcattgttcacccttacgttgcaatataggaattaatgctacaaaataaaagtaaagcttacctgaaaagtgcatagtttggggcaatggtatctacatctcccactgtgggaaaaccagcaaagcatcaaaactctcaattctcctgttaccgaatgcagatctgaattataagatgtttatgtttgaccattgtttcaacaatgggattttgttacgaattatccctttaactgaaaccctcagttttactgtttacattattaggaaaacagggatatcttttgaatctaaaaatttgatgtacagcatgtgatttttgaagtttacatgtaaagtcacagtataggtgaaataacgtttgtcatattttgagacgtatcctgcagccatgtttttacgtgagtgttttagtcaaagtacatggtagacagtctttcacaataaaaggaaaaggattttttttcctccaaatgtacatttatcaacctaatgattgatttttttaaaaagagatttcgccccagtctggtttatgaaagttcattgccctaaactgtgctgattgtttttaatcaagttataaatttccaacctagatcatgtatctaccaactctcctgcattttccaaaaggcattgagcttaaatattagtcttgcttagagtaggttatccacttacatgctgcgctaaagccatgcctttgaaactccttgtttaaaacatgatatgatttttgtgggcagtttcagaaaagaaaacaaacaaacaaaaatcgaccctttaattattacttgcaactcaacagatctccctgccgtactgccttttccaggaactttacttcagggctgtccagattgcagttgtgccccgtgtatgtggatctagttcacagagtctttggaagccagcagtcgtgccctccgtatactgtccactcattttatgtagatttggtatcctcagcagccagtgttaacaccactgtcacgtagtgtacagattcatcttttatgtatttaaagtaatccatactatgatttggtttttccctgcaccattaattctggcatcagatcagtttttgtgttgtgaagttctactgtggtttgacccaagaccacaaccatgagaccctgaagtaaagataaggtacacatacattatttgagtaactgtttccttgggggccaatctgtgtatgcttttagaagtttacagaatgcttttatttttgtctataacaaacagtctgtcatttatttctgttgataaaccatttggacagagtgaggacgtttgccctgttatctcctagtgctaacaatacactccagtcatgagccgggctttacaaataaagcacttttgatgactca

SEQ ID NO: 308028 - DNA, 1879 bp, Homo sapiens
ttttttttttttggagttgaaagatgtgagacagtattcagaataatgaagataataataatgattattataataatgatgatgattccaaggaaaaaacctacagcgaatgttccatttctaccccgcacgcagacactctccctaacactgataacctgagcccccagcactggacggaagaatgctggcgtctccgtgtgtactggttcagggttctggccccagccttgtcaggaccccctggtgtccagagcccccacccctcccgcaacaagcagctgatgccccagtgattctctatacatttttcacctcggccaatatgtccaggaaaactgcttacttctcttttcttgcctggagcttcattgttcacccttacgttgcaatataggaattaatgctacaaaataaaagtaaagcttacctgaaaagtgcatagtttggggcaatggtatctacatctcccactgtgggaaaaccagcaaagcatcaaaactctcaattctcctgttaccgaatgcagatctgaattataagatgtttatgtttgaccattgtttcaacaatgggattttgttacgaattatccctttaactgaaaccctcagttttactgtttacattattaggaaaacagggatatcttttgaatctaaaaatttgatgtacagcatgtgatttttgaagtttacatgtaaagtcacagtataggtgaaataacgtttgtcatattttgagacgtatcctgcagccatgtttttacgtgagtgttttagtcaaagtacatggtagacagtctttcacaataaaaggaaaaggattttttttcctccaaatgtacatttatcaacctaatgattgatttttttaaaaagagatttcgccccagtctggtttatgaaagttcattgccctaaactgtgctgattgtttttaatcaagttataaatttccaacctagatcatgtatctaccaactctcctgcattttccaaaaggcattgagcttaaatattagtcttgcttagagtaggttatccacttacatgctgcgctaaagccatgcctttgaaactccttgtttaaaacatgatatgatttttgtgggcagtttcagaaaagaaaacaaacaaacaaaaatcgaccctttaattattacttgcaactcaacagatctccctgccgtactgccttttccaggaactttacttcagggctgtccagattgcagttgtgccccgtgtatgtggatctagttcacagagtctttggaagccagcagtcgtgccctccgtatactgtccactcattttatgtagatttggtatcctcagcagccagtgttaacaccactgtcacgtagtgtacagattcatcttttatgtatttaaagtaatccatactatgatttggtttttccctgcaccattaattctggcatcagatcagtttttgtgttgtgaagttctactgtggtttgacccaagaccacaaccatgagaccctgaagtaaagataaggtacacatacattatttgagtaactgtttccttgggggccaatctgtgtatgcttttagaagtttacagaatgcttttatttttgtctataacaaacagtctgtcatttatttctgttgataaaccatttggacagagtgaggacgtttgccctgttatctcctagtgctaacaatacactccagtcatgagccgggctttacaaataaagcacttttgatgactcacaagatgaatccttttttcctctgtcccaattgtgtgtctctgttccaaacacattttaaatactcggtcctgacagtgtctttagctaatccttgaagaaataaaagtggaattgaatctttaaa

SEQ ID NO: 308029 - DNA, 1937 bp, Homo sapiens
ttttttttttttggagttgaaagatgtgagacagtattcagaataatgaagataataataatgattattataataatgatgatgattccaaggaaaaaacctacagcgaatgttccatttctaccccgcacgcagacactctccctaacactgataacctgagcccccagcactggacggaagaatgctggcgtctccgtgtgtactggttcagggttctggccccagccttgtcaggaccccctggtgtccagagcccccacccctcccgcaacaagcagctgatgccccagtgattctctatacatttttcacctcggccaatatgtccaggaaaactgcttacttctcttttcttgcctggagcttcattgttcacccttacgttgcaatataggaattaatgctacaaaataaaagtaaagcttacctgaaaagtgcatagtttggggcaatggtatctacatctcccactgtgggaaaaccagcaaagcatcaaaactctcaattctcctgttaccgaatgcagatctgaattataagatgtttatgtttgaccattgtttcaacaatgggattttgttacgaattatccctttaactgaaaccctcagttttactgtttacattattaggaaaacagggatatcttttgaatctaaaaatttgatgtacagcatgtgatttttgaagtttacatgtaaagtcacagtataggtgaaataacgtttgtcatattttgagacgtatcctgcagccatgtttttacgtgagtgttttagtcaaagtacatggtagacagtctttcacaataaaaggaaaaggattttttttcctccaaatgtacatttatcaacctaatgattgatttttttaaaaagagatttcgccccagtctggtttatgaaagttcattgccctaaactgtgctgattgtttttaatcaagttataaatttccaacctagatcatgtatctaccaactctcctgcattttccaaaaggcattgagcttaaatattagtcttgcttagagtaggttatccacttacatgctgcgctaaagccatgcctttgaaactccttgtttaaaacatgatatgatttttgtgggcagtttcagaaaagaaaacaaacaaacaaaaatcgaccctttaattattacttgcaactcaacagatctccctgccgtactgccttttccaggaactttacttcagggctgtccagattgcagttgtgccccgtgtatgtggatctagttcacagagtctttggaagccagcagtcgtgccctccgtatactgtccactcattttatgtagatttggtatcctcagcagccagtgttaacaccactgtcacgtagtgtacagattcatcttttatgtatttaaagtaatccatactatgatttggtttttccctgcaccattaattctggcatcagatcagtttttgtgttgtgaagttctactgtggtttgacccaagaccacaaccatgagaccctgaagtaaagataaggtacacatacattatttgagtaactgtttccttgggggccaatctgtgtatgcttttagaagtttacagaatgcttttatttttgtctataacaaacagtctgtcatttatttctgttgataaaccatttggacagagtgaggacgtttgccctgttatctcctagtgctaacaatacactccagtcatgagccgggctttacaaataaagcacttttgatgactcacaagatgaatccttttttcctctgtcccaattgtgtgtctctgttccaaacacattttaaatactcggtcctgacagtgtctttagctaaaatgtgtttggaacagagacattctaaagacactgtcaggaccgagtatttagctaatccttgaagaaataaaagtggaattgaaaaaaaaaaa

SEQ ID NO: 308030 - DNA, 1542 bp, Homo sapiens
ttttttttttttggagttgaaagatgtgagacagtattcagaataatgaagataataataatgattattataataatgatgatgattctctatacatttttcacctcggccaatatgtccaggaaaactgcttacttctcttttcttgcctggagcttcattgttcacccttacgttgcaatataggaattaatgctacaaaataaaagtaaagcttacctgaaaagtgcatagtttggggcaatggtatctacatctcccactgtgggaaaaccagcaaagcatcaaaactctcaattctcctgttaccgaatgcagatctgaattataagatgtttatgtttgaccattgtttcaacaatgggattttgttacgaattatccctttaactgaaaccctcagttttactgtttacattattaggaaaacagggatatcttttgaatctaaaaatttgatgtacagcatgtgatttttgaagtttacatgtaaagtcacagtataggtgaaataacgtttgtcatattttgagacgtatcctgcagccatgtttttacgtgagtgttttagtcaaagtacatggtagacagtctttcacaataaaaggaaaaggattttttttcctccaaatgtacatttatcaacctaatgattgatttttttaaaaagagatttcgccccagtctggtttatgaaagttcattgccctaaactgtgctgattgtttttaatcaagttataaatttccaacctagatcatgtatctaccaactctcctgcattttccaaaaggcattgagcttaaatattagtcttgcttagagtaggttatccacttacatgctgcgctaaagccatgcctttgaaactccttgtttaaaacatgatatgatttttgtgggcagtttcagaaaagaaaacaaacaaacaaaaatcgaccctttaattattacttgcaactcaacagatctccctgccgtactgccttttccaggaactttacttcagggctgtccagattgcagttgtgccccgtgtatgtggatctagttcacagagtctttggaagccagcagtcgtgccctccgtatactgtccactcattttatgtagatttggtatcctcagcagccagtgttaacaccactgtcacgtagtgtacagattcatcttttatgtatttaaagtaatccatactatgatttggtttttccctgcaccattaattctggcatcagatcagtttttgtgttgtgaagttctactgtggtttgacccaagaccacaaccatgagaccctgaagtaaagataaggtacacatacattatttgagtaactgtttccttgggggccaatctgtgtatgcttttagaagtttacagaatgcttttatttttgtctataacaaacagtctgtcatttatttctgttgataaaccatttggacagagtgaggacgtttgccctgttatctcctagtgctaacaatacactccagtcatgagccgggctttacaaataaagcacttttgatgactca

SEQ ID NO: 308031 - DNA, 2547 bp, Homo sapiens
acagggaggtggtggcgccatcagtgtgggctgtgccgtggctggaagttactgtgaggcggcggctaagaaggcggctctggtggcggcggtggaggctgaggcggcggccgaggcggcgacggaggaaacagaagatggcagattttttgaaaggactgcctgtctacaacaaaagcaattttagtcgatttcacgcggactccgtgtgcaaagcctcgaaccgacggccctcagtctacctgcctacccgcgagtacccgtctgaacagatcatcgtgacagaaaagacaaacatcctcctgcgctacctgcatcagcaatgggacaaaaagaacgctgccaagaagagagaccaggagcaagtggagctggaaggcgagagctccgcacctccccgcaaggtggcgcggaccgacagcccagacatgcacgaggacacttaagactctcaactccacaggcgcctcctgccaggtctgctcctcggtcgcccacccgcctgcccgccatgttgcgtgctccgtgtccaccccaataaaagggtctttcctacttgaactcgcgtctttgctccacacaccttggctgcagaggacggagcccctgggagtcatccctgttgtcaccaagaggagtgagaagggccccccacgccagggccccaggaccggctggattctctcgtgggcttgctgaggccaccatgttcaaggccaagacctgcctggaccatcccctctgcctctcctgtcaaggtgaccccaaggacaggtcattcctgagagacggtccatggtgccaaggatggagcggggtcagccccctgcctgggataccgccaagcagggcagcgcacctgtcagacaccgcagagatggccggcctcatccgggggcctggggtctctggcctctgctgctcccctgaggcatggtgacagtacagacggcatctggccggtcttgctgtcctaggtggtggcctcacccttgctgggtcatagaggagctgtacagaaggttggcacctggcagttggcatgtgccatggccgctcatggggacccctcttccgccagctgggctgggtttggggctgagcttgggtatgtaggggtgttcgggctctgggcagaaggtttgtggccctgaccactgagcctggggctgggggaacaccgcttctccccttattgcccccactggtggtggtggggatctcagttttcttttgttttgttttgtttgtttgtttgagttggggtcttgtactctttcccaggctggagtgcagtggcgtaatcacagctcactgcagcctcgacctcaagccttcctcccacctcagccttccaagccgctgggaccacaggcacccaccaccatgcctggctaatttttttttttttttgagatggagtctcgctgtgtctcccaggctggagtgcagtggcaagatctcagctcactacaacctccgcctcccaggttcaagtgattctcctacctcagcctcctgagtagctgggattacacgcgtgcgcccctacacccagctaatttttctatttttagtggagacggcgttttgtcatgttggccaggctggtctcgaactcctgacctcaggtgcttcgcctgcctcggcctcccaaagtgctgtgaccgcacctggctgcctggctaatattttaaaaattttttgtagagacagggtttcaccatgttgcccaggctggtctcaaactcctgggctcaagtcatccaccttcctcagcctcccaaagtgctggggttacagacgtgagccaccgtgcctggcagaggtctctgttttgagagctgagtctgagggcgttgggatggtgtagggttgggccacagagctagcagacactccgggctatggagggtccgcctgccccagattccactgtggagggccctgcctgtgtcagaccctcgggcctaggcggcccatctctcccaaggacggagagtgccagggtgggctcccgtcctacacaaggagtggctgaccaggcccaggcacagcacagccaccctgctgtacctcccagctcccggcagtgtctacaccacagtgatggtgctacaggggccatgtggtcacaggacaggtggtcaggaaatgcacacttgactgcggtcgatggtgccgggtccggctgaatgccctggaggctcccaggccagctggggagtcccagtccccagggttggtgtgacctgggcaggcctgcggtgtccatctgtgaatgactgagatggtgggacttcagcttccaaggccaggggccagagtgggagcagggggcactcccgcctttcccctcggcctgtctagacctctctggctcccagtttctgctttgagtggctgggggctgtctcctgcctgtgctgtctgcccgtcgctctgcagggctgctgggcgggcacctccttcccctcccctacctcagctccctcctttggggtctgagggctgtgccccagcttgcctccctgtggcctcccccta

SEQ ID NO: 308032 - DNA, 2020 bp, Homo sapiens
tatttcatgcaggggctggggctttacattgatacttacttgtcgtcgctcttcactttacatgcagaggacggagcccctgggagtcatccctgttgtcaccaagaggagtgagaagggccccccacgccagggccccaggaccggctggattctctcgtgggcttgctgaggccaccatgttcaaggccaagacctgcctggaccatcccctctgcctctcctgtcaaggtgaccccaaggacaggtcattcctgagagacggtccatggtgccaaggatggagcggggtcagccccctgcctgggataccgccaagcagggcagcgcacctgtcagacaccgcagagatggccggcctcatccgggggcctggggtctctggcctctgctgctcccctgaggcatggtgacagtacagacggcatctggccggtcttgctgtcctaggtggtggcctcacccttgctgggtcatagaggagctgtacagaaggttggcacctggcagttggcatgtgccatggccgctcatggggacccctcttccgccagctgggctgggtttggggctgagcttgggtatgtaggggtgttcgggctctgggcagaaggtttgtggccctgaccactgagcctggggctgggggaacaccgcttctccccttattgcccccactggtggtggtggggatctcagttttcttttgttttgttttgtttgtttgtttgagttggggtcttgtactctttcccaggctggagtgcagtggcgtaatcacagctcactgcagcctcgacctcaagccttcctcccacctcagccttccaagccgctgggaccacaggcacccaccaccatgcctggctaatttttttttttttttgagatggagtctcgctgtgtctcccaggctggagtgcagtggcaagatctcagctcactacaacctccgcctcccaggttcaagtgattctcctacctcagcctcctgagtagctgggattacacgcgtgcgcccctacacccagctaatttttctatttttagtggagacggcgttttgtcatgttggccaggctggtctcgaactcctgacctcaggtgcttcgcctgcctcggcctcccaaagtgctgtgaccgcacctggctgcctggctaatattttaaaaattttttgtagagacagggtttcaccatgttgcccaggctggtctcaaactcctgggctcaagtcatccaccttcctcagcctcccaaagtgctggggttacagacgtgagccaccgtgcctggcagaggtctctgttttgagagctgagtctgagggcgttgggatggtgtagggttgggccacagagctagcagacactccgggctatggagggtccgcctgccccagattccactgtggagggccctgcctgtgtcagaccctcgggcctaggcggcccatctctcccaaggacggagagtgccagggtgggctcccgtcctacacaaggagtggctgaccaggcccaggcacagcacagccaccctgctgtacctcccagctcccggcagtgtctacaccacagtgatggtgctacaggggccatgtggtcacaggacaggtggtcaggaaatgcacacttgactgcggtcgatggtgccgggtccggctgaatgccctggaggctcccaggccagctggggagtcccagtccccagggttggtgtgacctgggcaggcctgcggtgtccatctgtgaatgactgagatggtgggacttcagcttccaaggccaggggccagagtgggagcagggggcactcccgcctttcccctcggcctgtctagacctctctggctcccagtttctgctttgagtggctgggggctgtctcctgcctgtgctgtctgcccgtcgctctgcagggctgctgggcgggcacctccttcccctcccctacctcagctccctcctttggggtctgagggctgtgccccagcttgcctccctgtggcctcccccta

SEQ ID NO: 308033 - DNA, 1114 bp, Homo sapiens
acagggaggtggtggcgccatcagtgtgggctgtgccgtggctggaagttactgtgaggcggcggctaagaaggcggctctggtggcggcggtggaggctgaggcggcggccgaggcggcgacggaggaaacagaagatggcagattttttgaaaggactgcctgtctacaacaaaagcaattttagtcgatttcacgcggactccgtgtgcaaagcctcgaaccgacggccctcagtctacctgcctacccgcgagtacccgtctgaacagatcatcgtgacagaaaagacaaacatcctcctgcgctacctgcatcagcaatgggacaaaaagaacgctgccaagaagagagaccaggagcaagtggagctggaaggcgagagctccgcacctccccgcaaggtggcgcggaccgacagcccagacatgcacgaggacacttaagactctcaactccacaggcgcctcctgccaggtctgctcctcggtcgcccacccgcctgcccgccatgtgtaagcaccccgcccgcccgcctccctgccggcccatccacaccctgcgtccacaccacttccaacctcataggagccgatgtatttattttccttgagtttttatttatgctgtaacctgtatcaagcgttggttaaaggggacatcagacccagtagtgtgatgttggtagatgctttttaaaaaaaacaacattgtccccccgacccccgccttccatcgggccagttccccgattcctgcccccagttctccagagaaccagagtgtgtctgtgagagtctctagcgggggctttactgtggccgggcgacaggggcgggcccggggtggcctgacctaccaggacagccgagtggccttctcccccccaacaccggtccaggccattgagactcggtcttgtcccacgcttcgcccggaactttcccatgcccagacctcactcagcgtgcacgcacgttggggagaagtcggcccttgggatctttctcttgagtcattttatttttatcatggactagtgcgtgctccgtgtccaccccaataaaagggtctttcctacttgaactcgcgtctttgctccacacaccttggc

SEQ ID NO: 308034 - DNA, 3072 bp, Homo sapiens
acagggaggtggtggcgccatcagtgtgggctgtgccgtggctggaagttactgtgaggcggcggctaagaaggcggctctggtggcggcggtggaggctgaggcggcggccgaggcggcgacggaggaaacagaagatggcagattttttgaaaggactgcctgtctacaacaaaagcaattttagtcgatttcacgcggactccgtgtgcaaagcctcgaaccgacggccctcagtctacctgcctacccgcgagtacccgtctgaacagatcatcgtgacagaaaagacaaacatcctcctgcgctacctgcatcagcaatgggacaaaaagaacgctgccaagaagagagaccaggagcaagtggagctggaaggcgagagctccgcacctccccgcaaggtggcgcggaccgacagcccagacatgcacgaggacacttaagactctcaactccacaggcgcctcctgccaggtctgctcctcggtcgcccacccgcctgcccgccatgtgtaagcaccccgcccgcccgcctccctgccggcccatccacaccctgcgtccacaccacttccaacctcataggagccgatgtatttattttccttgagtttttatttatgctgtaacctgtatcaagcgttggttaaaggggacatcagacccagtagtgtgatgttggtagatgctttttaaaaaaaacaacattgtccccccgacccccgccttccatcgggccagttccccgattcctgcccccagttctccagagaaccagagtgtgtctgtgagagtctctagcgggggctttactgtggccgggcgacaggggcgggcccggggtggcctgacctaccaggacagccgagtggccttctcccccccaacaccggtccaggccattgagactcggtcttgtcccacgcttcgcccggaactttcccatgcccagacctcactcagcgtgcacgcacgttggggagaagtcggcccttgggatctttctcttgagtcattttatttttatcatggactagtgcgtgctccgtgtccaccccaataaaagggtctttcctacttgaactcgcgtctttgctccacacaccttggctgcagaggacggagcccctgggagtcatccctgttgtcaccaagaggagtgagaagggccccccacgccagggccccaggaccggctggattctctcgtgggcttgctgaggccaccatgttcaaggccaagacctgcctggaccatcccctctgcctctcctgtcaaggtgaccccaaggacaggtcattcctgagagacggtccatggtgccaaggatggagcggggtcagccccctgcctgggataccgccaagcagggcagcgcacctgtcagacaccgcagagatggccggcctcatccgggggcctggggtctctggcctctgctgctcccctgaggcatggtgacagtacagacggcatctggccggtcttgctgtcctaggtggtggcctcacccttgctgggtcatagaggagctgtacagaaggttggcacctggcagttggcatgtgccatggccgctcatggggacccctcttccgccagctgggctgggtttggggctgagcttgggtatgtaggggtgttcgggctctgggcagaaggtttgtggccctgaccactgagcctggggctgggggaacaccgcttctccccttattgcccccactggtggtggtggggatctcagttttcttttgttttgttttgtttgtttgtttgagttggggtcttgtactctttcccaggctggagtgcagtggcgtaatcacagctcactgcagcctcgacctcaagccttcctcccacctcagccttccaagccgctgggaccacaggcacccaccaccatgcctggctaatttttttttttttttgagatggagtctcgctgtgtctcccaggctggagtgcagtggcaagatctcagctcactacaacctccgcctcccaggttcaagtgattctcctacctcagcctcctgagtagctgggattacacgcgtgcgcccctacacccagctaatttttctatttttagtggagacggcgttttgtcatgttggccaggctggtctcgaactcctgacctcaggtgcttcgcctgcctcggcctcccaaagtgctgtgaccgcacctggctgcctggctaatattttaaaaattttttgtagagacagggtttcaccatgttgcccaggctggtctcaaactcctgggctcaagtcatccaccttcctcagcctcccaaagtgctggggttacagacgtgagccaccgtgcctggcagaggtctctgttttgagagctgagtctgagggcgttgggatggtgtagggttgggccacagagctagcagacactccgggctatggagggtccgcctgccccagattccactgtggagggccctgcctgtgtcagaccctcgggcctaggcggcccatctctcccaaggacggagagtgccagggtgggctcccgtcctacacaaggagtggctgaccaggcccaggcacagcacagccaccctgctgtacctcccagctcccggcagtgtctacaccacagtgatggtgctacaggggccatgtggtcacaggacaggtggtcaggaaatgcacacttgactgcggtcgatggtgccgggtccggctgaatgccctggaggctcccaggccagctggggagtcccagtccccagggttggtgtgacctgggcaggcctgcggtgtccatctgtgaatgactgagatggtgggacttcagcttccaaggccaggggccagagtgggagcagggggcactcccgcctttcccctcggcctgtctagacctctctggctcccagtttctgctttgagtggctgggggctgtctcctgcctgtgctgtctgcccgtcgctctgcagggctgctgggcgggcacctccttcccctcccctacctcagctccctcctttggggtctgagggctgtgccccagcttgcctccctgtggcctcccccta

SEQ ID NO: 308035 - DNA, 1138 bp, Homo sapiens
taggtagagaccagggatgctgctgaacaccccgcaatgcacaggatgcccccgccgttcgcaaagcacagctgtgctttgggcggcggctaagaaggcggctctggtggcggcggtggaggctgaggcggcggccgaggcggcgacggaggaaacagaagatggcagattttttgaaaggactgcctgtctacaacaaaagcaattttagtcgatttcacgcggactccgtgtgcaaagcctcgaaccgacggccctcagtctacctgcctacccgcgagtacccgtctgaacagatcatcgtgacagaaaagacaaacatcctcctgcgctacctgcatcagcaatgggacaaaaagaacgctgccaagaagagagaccaggagcaagtggagctggaaggcgagagctccgcacctccccgcaaggtggcgcggaccgacagcccagacatgcacgaggacacttaagactctcaactccacaggcgcctcctgccaggtctgctcctcggtcgcccacccgcctgcccgccatgtgtaagcaccccgcccgcccgcctccctgccggcccatccacaccctgcgtccacaccacttccaacctcataggagccgatgtatttattttccttgagtttttatttatgctgtaacctgtatcaagcgttggttaaaggggacatcagacccagtagtgtgatgttggtagatgctttttaaaaaaaacaacattgtccccccgacccccgccttccatcgggccagttccccgattcctgcccccagttctccagagaaccagagtgtgtctgtgagagtctctagcgggggctttactgtggccgggcgacaggggcgggcccggggtggcctgacctaccaggacagccgagtggccttctcccccccaacaccggtccaggccattgagactcggtcttgtcccacgcttcgcccggaactttcccatgcccagacctcactcagcgtgcacgcacgttggggagaagtcggcccttgggatctttctcttgagtcattttatttttatcatggactagtgcgtgctccgtgtccaccccaataaaagggtctttcctacttgaactcgcgtctttgctccacacaccttggc

SEQ ID NO: 308036 - DNA, 1104 bp, Homo sapiens
acagggaggtggtggcgccatcagtgtgggctgtgccgtggctggaagttactgtgaggcggcggctaagaaggcggctctggtggcggcggtggaggctgaggcggcggccgaggcggcgacggaggaaacagaagatggcagattttttgaaaggactgcctgtctacaacaaaagcaattttagtcgatttcacgcggactccgtgtgcaaagcctcgaaccgacggccctcagtctacctgcctacccgcgagtacccgtctgaacagatcatcgtgacagaaaagacaaacatcctcctgcgctacctgcatcagcaatgggacaaaaagaacgctgccaagaagagagaccaggagcaagtggagctggaaggcgagagctccgcacctccccgcaaggtggcgcggaccgacagcccagacatgcacgaggacacttaagactctcaactccacaggcgcctcctgccaggtctgctcctcggtcgcccacccgcctgcccgccatgtgtaagcaccccgcccgcccgcctccctgccggcccatccacaccctgcgtccacaccacttccaacctcataggagccgatgtatttattttccttgagtttttatttatgctgtaacctgtatcaagcgttggttaaaggggacatcagacccagtagtgtgatgttggtagatgctttttctgcccccagttctccagagaaccagagtgtgtctgtgagagtctctagcgggggctttactgtggccgggcgacaggggcgggcccggggtggcctgacctaccaggacagccgagtggccttctcccccccaacaccggtccaggccattgagactcggtcttgtcccacgcttcgcccggaactttcccatgcccagacctcactcagcgtgcacgcacgttggggagaagtcggcccttgggatctttctcttgagtcaacacaccctgtcgctcatggactactgcgtgcaccgagaacaacccaacgggcaaaccaaacacacacacccacaccaccaaacagcacaaccccacacccacaccccacgggcacgagagcccaacccaacacccgacccgtc

SEQ ID NO: 308037 - DNA, 1055 bp, Homo sapiens
  misc_feature (71)..(71): n is a, c, g, or t
  misc_feature (73)..(73): n is a, c, g, or t
gtgagagtgagccgcaggcttcgggaggcgagggggcggggggagcagcgcctgaggcggcgacggaggananagaagatggcagattttttgaaaggactgcctgtctacaacaaaagcaattttagtcgatttcacgcggactccgtgtgcaaagcctcgaaccgacggccctcagtctacctgcctacccgcgagtacccgtctgaacagatcatcgtgacagaaaagacaaacatcctcctgcgctacctgcatcagcaatgggacaaaaagaacgctgccaagaagagagaccaggagcaagtggagctggaaggcgagagctccgcacctccccgcaaggtggcgcggaccgacagcccagacatgcacgaggacacttaagactctcaactccacaggcgcctcctgccaggtctgctcctcggtcgcccacccgcctgcccgccatgtgtaagcaccccgcccgcccgcctccctgccggcccatccacaccctgcgtccacaccacttccaacctcataggagccgatgtatttattttccttgagtttttatttatgctgtaacctgtatcaagcgttggttaaaggggacatcagacccagtagtgtgatgttggtagatgctttttaaaaaaaacaacattgtccccccgacccccgccttccatcgggccagttccccgattcctgcccccagttctccagagaaccagagtgtgtctgtgagagtctctagcgggggctttactgtggccgggcgacaggggcgggcccggggtggcctgacctaccaggacagccgagtggccttctcccccccaacaccggtccaggccattgagactcggtcttgtcccacgcttcgcccggaactttcccatgcccagacctcactcagcgtgcacgcacgttggggagaagtcggcccttgggatctttctcttgagtcattttatttttatcatggactagtgcgtgctccgtgtccaccccaataaaagggtctttcctacttgaactcgcgtctttgctccacacaccttggc

SEQ ID NO: 308038 - DNA, 1066 bp, Homo sapiens
  misc_feature (82)..(82): n is a, c, g, or t
  misc_feature (84)..(84): n is a, c, g, or t
taattccatcccgggccggcgttttcacttgttagattcctggcccgtggctgtcaatttacacgaggcggcgacggaggananagaagatggcagattttttgaaaggactgcctgtctacaacaaaagcaattttagtcgatttcacgcggactccgtgtgcaaagcctcgaaccgacggccctcagtctacctgcctacccgcgagtacccgtctgaacagatcatcgtgacagaaaagacaaacatcctcctgcgctacctgcatcagcaatgggacaaaaagaacgctgccaagaagagagaccaggagcaagtggagctggaaggcgagagctccgcacctccccgcaaggtggcgcggaccgacagcccagacatgcacgaggacacttaagactctcaactccacaggcgcctcctgccaggtctgctcctcggtcgcccacccgcctgcccgccatgtgtaagcaccccgcccgcccgcctccctgccggcccatccacaccctgcgtccacaccacttccaacctcataggagccgatgtatttattttccttgagtttttatttatgctgtaacctgtatcaagcgttggttaaaggggacatcagacccagtagtgtgatgttggtagatgctttttaaaaaaaacaacattgtccccccgacccccgccttccatcgggccagttccccgattcctgcccccagttctccagagaaccagagtgtgtctgtgagagtctctagcgggggctttactgtggccgggcgacaggggcgggcccggggtggcctgacctaccaggacagccgagtggccttctcccccccaacaccggtccaggccattgagactcggtcttgtcccacgcttcgcccggaactttcccatgcccagacctcactcagcgtgcacgcacgttggggagaagtcggcccttgggatctttctcttgagtcattttatttttatcatggactagtgcgtgctccgtgtccaccccaataaaagggtctttcctacttgaactcgcgtctttgctccacacaccttggc

SEQ ID NO: 308039 - DNA, 1003 bp, Homo sapiens
gagtagctgcgagtgtgctcagaagcaaaaacatgggacttttggagatctctggagttgggggtactgagttccagccccaaaaagacctcccagggcagtgtcaggggaggagcctggggaggggaggcgtctgcgactttctctatctttcctccttagtcatcgtgacagaaaagacaaacatcctcctgcgctacctgcatcagcaatgggacaaaaagaacgctgccaagaagagagaccaggagcaagtggagctggaaggcgagagctccgcacctccccgcaaggtggcgcggaccgacagcccagacatgcacgaggacacttaagactctcaactccacaggcgcctcctgccaggtctgctcctcggtcgcccacccgcctgcccgccatgtgtaagcaccccgcccgcccgcctccctgccggcccatccacaccctgcgtccacaccacttccaacctcataggagccgatgtatttattttccttgagtttttatttatgctgtaacctgtatcaagcgttggttaaaggggacatcagacccagtagtgtgatgttggtagatgctttttaaaaaaaacaacattgtccccccgacccccgccttccatcgggccagttccccgattcctgcccccagttctccagagaaccagagtgtgtctgtgagagtctctagcgggggctttactgtggccgggcgacaggggcgggcccggggtggcctgacctaccaggacagccgagtggccttctcccccccaacaccggtccaggccattgagactcggtcttgtcccacgcttcgcccggaactttcccatgcccagacctcactcagcgtgcacgcacgttggggagaagtcggcccttgggatctttctcttgagtcattttatttttatcatggactagtgcgtgctccgtgtccaccccaataaaagggtctttcctacttgaactcgcgtctttgctccacacaccttggc

SEQ ID NO: 308040 - DNA, 1056 bp, Homo sapiens
acagggaggtggtggcgccatcagtgtgggctgtgccgtggctggaagttactgtgaggcggcggctaagaaggcggctctggtggcggcggtggaggctgaggcggcggccgaggcggcgacggaggaaacagaagatggcagattttttgaaaggactgcctgtctacaacaaaagcaattttagtcgatttcacgcggactccgtgtgcaaagcctcgaaccgacggccctcagtctacctgcctacccgcgagtacccgtctgaacagatcatcgtgacagaaaagacaaacatcctcctgcgctacctgcatcagcaatgggacaaaaagctccccgcaaggtggcgcggaccgacagcccagacatgcacgaggacacttaagactctcaactccacaggcgcctcctgccaggtctgctcctcggtcgcccacccgcctgcccgccatgtgtaagcaccccgcccgcccgcctccctgccggcccatccacaccctgcgtccacaccacttccaacctcataggagccgatgtatttattttccttgagtttttatttatgctgtaacctgtatcaagcgttggttaaaggggacatcagacccagtagtgtgatgttggtagatgctttttaaaaaaaacaacattgtccccccgacccccgccttccatcgggccagttccccgattcctgcccccagttctccagagaaccagagtgtgtctgtgagagtctctagcgggggctttactgtggccgggcgacaggggcgggcccggggtggcctgacctaccaggacagccgagtggccttctcccccccaacaccggtccaggccattgagactcggtcttgtcccacgcttcgcccggaactttcccatgcccagacctcactcagcgtgcacgcacgttggggagaagtcggcccttgggatctttctcttgagtcattttatttttatcatggactagtgcgtgctccgtgtccaccccaataaaagggtctttcctacttgaactcgcgtctttgctccacacaccttggc

SEQ ID NO: 308041 - DNA, 1193 bp, Homo sapiens
atgtggtgggggtgactccgggtgccaggaaacacctgtctatcaccaggcatgggtccagaaagtgctctgggcagggcttagtggggcaggtcctggtggtaggaggggctgcctagccagggaccctggggccccccactgtactccaggcctacctctgtgatgctgctgcaggggcctgggctggcattatgactctgggagcttcacccacgtgaagactcacagcctccagctgggcaacatagtgaaacccccatgtctaccaaaagtaaaaatattaagcgtggtggtatgtgcctgtagtcctagctactccagaggctgagctgggaggattgcttgagcccagaaggttgaggctgtccgaaaaaaaagactcacagcccctctcttttccctgtcccccagaacgctgccaagaagagagaccaggagcaagtggagctggaaggcgagagctccgcacctccccgcaaggtggcgcggaccgacagcccagacatgcacgaggacacttaagactctcaactccacaggcgcctcctgccaggtctgctcctcggtcgcccacccgcctgcccgccatgtgtaagcaccccgcccgcccgcctccctgccggcccatccacaccctgcgtccacaccacttccaacctcataggagccgatgtatttattttccttgagtttttatttatgctgtaacctgtatcaagcgttggttaaaggggacatcagacccagtagtgtgatgttggtagatgctttttaaaaaaaacaacattgtccccccgacccccgccttccatcgggccagttccccgattcctgcccccagttctccagagaaccagagtgtgtctgtgagagtctctagcgggggctttactgtggccgggcgacaggggcgggcccggggtggcctgacctaccaggacagccgagtggccttctcccccccaacaccggtccaggccattgagactcggtcttgtcccacgcttcgcccggaactttcccatgcccagacctcactcagcgtgcacgcacgttggggagaagtcggcccttgggatctttctcttgagtcattttatttttatcatggactagtgcgtgctccgtgtccaccccaataaaagggtctttcctacttgaactcgcgtctttgctccacacaccttggc

SEQ ID NO: 308042 - DNA, 855 bp, Homo sapiens
agtcctttcaaaaaatctgccatcttctgtttcctccgtcgccgccttgccgccgcctcagcaatgggacaaaaagaacgctgccaagaagagagaccaggagcaagtggagctggaaggcgagagctccgcacctccccgcaaggtggcgcggaccgacagcccagacatgcacgaggacacttaagactctcaactccacaggcgcctcctgccaggtctgctcctcggtcgcccacccgcctgcccgccatgtgtaagcaccccgcccgcccgcctccctgccggcccatccacaccctgcgtccacaccacttccaacctcataggagccgatgtatttattttccttgagtttttatttatgctgtaacctgtatcaagcgttggttaaaggggacatcagacccagtagtgtgatgttggtagatgctttttaaaaaaaacaacattgtccccccgacccccgccttccatcgggccagttccccgattcctgcccccagttctccagagaaccagagtgtgtctgtgagagtctctagcgggggctttactgtggccgggcgacaggggcgggcccggggtggcctgacctaccaggacagccgagtggccttctcccccccaacaccggtccaggccattgagactcggtcttgtcccacgcttcgcccggaactttcccatgcccagacctcactcagcgtgcacgcacgttggggagaagtcggcccttgggatctttctcttgagtcattttatttttatcatggactagtgcgtgctccgtgtccaccccaataaaagggtctttcctacttgaactcgcgtctttgctccacacaccttggc

SEQ ID NO: 308043 - DNA, 3471 bp, Homo sapiens
tgtgtgtgccttctccgctctcgctatctttctccttcgtctggtccctctcttgttgcgctttgtcctgtttctacttgcctttgttctggtcttgcctcgtctggtgtgttccctccgtttcttcttgatgtcttcttggttcgtcgtcgtgttgtctccgcgtgtctgtgcacatctcgtccaactgattttccctcttctctcggttcgtgtccaatcgcttgtggtccattagtcagctgtcatgtttcagtgagtagcgttattagttttctatgtctgtcgtatgtgtttgtttgttttattttttgattttattctcttgtttgtttgttctaattgtttgttaattgtttgagtttttgtgtttgtctttaattgtttgttttttgtagtgtgtgtgcgtctctctggttatctgggtctagcttcctgcccgtcatcctcttggatgtctggcgtccctagcgtgtctacttgtctcgtcctgattgtggtatctactgttcgatatggctcgttgtgtgcgcatatccttttttgctgtcctgctgtcttgccctttcctcctgtgcccattgggtgtcgtctcttctgtctgcttctgtgtgtcggtgtgtctgattctctcgtcttttgtttcttggctatgttgtgttttaatggtggttcttttcgtcgtttgtgtgcgtcggcgtctttcgcgcgtcgttctgtgtgtcgctgtatgttcctatttcatgtccttcttgggttggttctcttttctctcggtagcgtgtgtgcttattccttcttctagtttatgtgattgctcttgtctgtttttttctacttgtttccctttgtcgtttcttttatctttttatcttgtctggttttattccccttgtttttcattatgtctgtttttggttttttctatgtgggtgttctattcacgattctctctttgttaggtttgttgatttgtttgggtatgattgtcgtttgtttttagttctgtttatcttagcattttgtgcctcccgttctgttctctctcgtctcttcgcagtcatgtgctcatgtttctctcttgaggtttctcttgttcgctccatgtatgcttctcaggagatatctcatgtatgttgtagtacttgttgatgtagttctgcttattcgtgtgtgtgctgttatctgtggtccgtggctgacagggtgcatggtctctcgtgtggtggcctgatcctatcctatggatcatgccgtatgtggcattctgcctcctctctctaatccaacaccggtccaggccattgagactcggtcttgtcccacgcttcgcccggaactttcccatgcccagacctcactcagcgtgcacgcacgttggggagaagtcggcccttgggatctttctcttgagtcattttatttttatcatggactagtgcgtgctccgtgtccaccccaataaaagggtctttcctacttgaactcgcgtctttgctccacacaccttggctgcagaggacggagcccctgggagtcatccctgttgtcaccaagaggagtgagaagggccccccacgccagggccccaggaccggctggattctctcgtgggcttgctgaggccaccatgttcaaggccaagacctgcctggaccatcccctctgcctctcctgtcaaggtgaccccaaggacaggtcattcctgagagacggtccatggtgccaaggatggagcggggtcagccccctgcctgggataccgccaagcagggcagcgcacctgtcagacaccgcagagatggccggcctcatccgggggcctggggtctctggcctctgctgctcccctgaggcatggtgacagtacagacggcatctggccggtcttgctgtcctaggtggtggcctcacccttgctgggtcatagaggagctgtacagaaggttggcacctggcagttggcatgtgccatggccgctcatggggacccctcttccgccagctgggctgggtttggggctgagcttgggtatgtaggggtgttcgggctctgggcagaaggtttgtggccctgaccactgagcctggggctgggggaacaccgcttctccccttattgcccccactggtggtggtggggatctcagttttcttttgttttgttttgtttgtttgtttgagttggggtcttgtactctttcccaggctggagtgcagtggcgtaatcacagctcactgcagcctcgacctcaagccttcctcccacctcagccttccaagccgctgggaccacaggcacccaccaccatgcctggctaatttttttttttttttgagatggagtctcgctgtgtctcccaggctggagtgcagtggcaagatctcagctcactacaacctccgcctcccaggttcaagtgattctcctacctcagcctcctgagtagctgggattacacgcgtgcgcccctacacccagctaatttttctatttttagtggagacggcgttttgtcatgttggccaggctggtctcgaactcctgacctcaggtgcttcgcctgcctcggcctcccaaagtgctgtgaccgcacctggctgcctggctaatattttaaaaattttttgtagagacagggtttcaccatgttgcccaggctggtctcaaactcctgggctcaagtcatccaccttcctcagcctcccaaagtgctggggttacagacgtgagccaccgtgcctggcagaggtctctgttttgagagctgagtctgagggcgttgggatggtgtagggttgggccacagagctagcagacactccgggctatggagggtccgcctgccccagattccactgtggagggccctgcctgtgtcagaccctcgggcctaggcggcccatctctcccaaggacggagagtgccagggtgggctcccgtcctacacaaggagtggctgaccaggcccaggcacagcacagccaccctgctgtacctcccagctcccggcagtgtctacaccacagtgatggtgctacaggggccatgtggtcacaggacaggtggtcaggaaatgcacacttgactgcggtcgatggtgccgggtccggctgaatgccctggaggctcccaggccagctggggagtcccagtccccagggttggtgtgacctgggcaggcctgcggtgtccatctgtgaatgactgagatggtgggacttcagcttccaaggccaggggccagagtgggagcagggggcactcccgcctttcccctcggcctgtctagacctctctggctcccagtttctgctttgagtggctgggggctgtctcctgcctgtgctgtctgcccgtcgctctgcagggctgctgggcgggcacctccttcccctcccctacctcagctccctcctttggggtctgagggctgtgccccagcttgcctccctgtggcctcccccta

SEQ ID NO: 308044 - DNA, 3312 bp, Homo sapiens
agatctcccgttgtgtgagagaaacgcaagcacggagctcccttgacctgctgcatcctcctcggcaattttttttttttaagtcaaaaagcttggatttcctgaaattgttgaactggatgcggctgttgaagagtgaacttggatcattcattacagactattttcagaaccagcttcttgcaaaaggactgttctttgtggaggagaagatcaagctgtgtgaaggtgaaaatcgcattgaggttctggctgaagtctgggaccacttcttcactgagactctccctaccctgcaggcaatattttatccagttcagagtgttcacgagcccacaggcccaagtgagagttatttgcaactggaggagctggtgaagcaagtggtttctcctttcctcggcatcagcggggaccgtagcttctcaggccccacgtacacgctggccaggcggcactccagggtccggcccaaggtgactgtcctgaactatgcctccccgataaccgcagtcagccggccactgaatgagatggtcttgaccccactgacagagcaggagggggaagcctacctggagaagtgtggcagcgtgcggcggcacacggtggccaatgcccactcggacatccagctgctggccatggccaccatgatgcactcgggcctgggggaggaggccagcagtgagaacaagtgcctgctcctgccacccagcttccccccgccccaccggcagtgctccagtgagcccaacatcaccgacaaccctgacggactggaggagggggccaggggcagccaggagggctcggagctgaactgtgcttccctcagctgagtcgccacccctgggcctttccatctcctgttttgcaaccaggatgaggacccctccatctccgtggattactgaggggggctcttgctttatgcgatgctgccttatttcctttagggtactgtcctggtcaaaatgacctaaggggaaaccgttgttgtaaacctctttattttggtgactgtgaccacttctttgtagccaccaattgtagtgaccagttgcctaatggtcactttctgactccagccttgccagcctgactcagatcctcatctctgggcctttctccctccgatgttggactgcctgatgctcccaatgacatatccaatgctcctggcatttctggagcaggaggttgtcaggacaacacatataaccaccaaggatgtgttggcctttggagttcccctttaggttcctagtgatgtggaggtttatgggtgaaaaattagtggagagggaactcctctcccccattttgtgtagagtgaaaatagcctgaagcccctactcagcagggctctgggaatgtgccttccttattttagtttcagaattgctgggaaagttaccccactggtgggtgaggatctatcctcaacctacatccagatcctatgtgctgcttgcacagaggcctttggcttttgacccaggagggccgcgaggctggagctgccctgtctttcattgagccttagcatttccctctcaggcttcctctcaagctcaaggaactcacccccagataagaagctggtgcctcttgtctctctcatttcagaaacggactttctcatcatgctttcctatggtgggtatgaggggccagctgataccaaccaactggcctgtatctatctatctggatttgacttgaatttttaaaatgtgtatcgtttaaaaaaaaaaatgtttgcaaattttgcacataggatcttgcactgttcattttcagtggggtgagtcttcacactaaaaacacaagcagagctcctgggaaaagagactggaagtggttcaggataaagagatccatggtgggcagggctgttaggtcacagagctctagaagcagctggacttgaacccacaatggcttgtgtaaattcgtaaatttcatggtttctaggaaaagctgcattggggtggggagacccagtttgcctcataggcagaggattctccaggaagcatggaaaatggaatgtttccatgctttacagtgctgggagagaggggagatgtgggcaggaccttttggaaggatgtttattctctgtggttaaagaaatgctgagaatttctagcatgtgaagcacttgggggcagcaggccttggcacggtgctgcatccttctactgctccctccaggtctgggggcttttatccaccttgaatccctatcctcctctttgtagttgtcggtctcactgataacagctccagaaaaaaagacaaggctccccctctgacccttcctgttggtatttatgaaatctcaaagagatgagccaccttggcttccaatatggcaagagggtgctgggagaaggtgaagatcagtctaagctgccacggtgatgagaccttctcattatttaactcttgatggcatttcccttctgagtgaagatttgaaatatgattgattagaattgtgctcttgatggctgggaatttagaaattttattttaagagttatttcattttcatcctaagagtgatgggagagaaatgtccaaaagagatctgctgatctgctgagaatttcaaacaaacaaaaaaataatctctatgtatgtgttggataaagtctacagactgactaacatgcattagcaaatggagcatcagtaggtagcaacatgataatttatgtaactgatagcttctgtccttattagtacacttaacatttgagactagtatttattgatccaggcaaagtaattaattaatcatgcttgggcttactttttcagtttgtaaggttaagcatatgtgcatgcatgcgtgtgtatataaatgccttttccatatcttaaatgtccctgatgaggagagcagtcatcaattaaatatataagctcttaaaatgagaatggaagtgtcagtatagacccagtgtacttaagtgctgatgactgttagccagtttacaactttttaccatcgatgtacacatttgatatttgtgcagtaaatagactgtacctataaaaaattttattgatgtttatggtcatgttagctatcagagagctattggagtgagagctgaggtgtccttaaccactttttctctcctagattcattttcattatttatgctaggattttcttatggttgacatttgatgacaggaagcaatcatgactcttcaagtgagctcacagaaacctttcatgttgtctgtttccaaaatggattcaataaacaacattttgtccatgttacc

SEQ ID NO: 308045 - DNA, 3031 bp, Homo sapiens
  misc_feature (3)..(3): n is a, c, g, or t
  misc_feature (6)..(8): n is a, c, g, or t
  misc_feature (57)..(57): n is a, c, g, or t
ggnagnnngggagatcaaaagcctgggaaccaagtccccaacaaaggacccgagganggccttatccaggctttgcatctctctgggggtttgaaaggagctgctcttgctggctccggtgcaggggatgaatgccagtgaatgccagtgttcagcagggctcctgccaggcggcactccagggtccggcccaaggtgactgtcctgaactatgcctccccgataaccgcagtcagccggccactgaatgagatggtcttgaccccactgacagagcaggagggggaagcctacctggagaagtgtggcagcgtgcggcggcacacggtggccaatgcccactcggacatccagctgctggccatggccaccatgatgcactcgggcctgggggaggaggccagcagtgagaacaagtgcctgctcctgccacccagcttccccccgccccaccggcagtgctccagtgagcccaacatcaccgacaaccctgacggactggaggagggggccaggggcagccaggagggctcggagctgaactgtgcttccctcagctgagtcgccacccctgggcctttccatctcctgttttgcaaccaggatgaggacccctccatctccgtggattactgaggggggctcttgctttatgcgatgctgccttatttcctttagggtactgtcctggtcaaaatgacctaaggggaaaccgttgttgtaaacctctttattttggtgactgtgaccacttctttgtagccaccaattgtagtgaccagttgcctaatggtcactttctgactccagccttgccagcctgactcagatcctcatctctgggcctttctccctccgatgttggactgcctgatgctcccaatgacatatccaatgctcctggcatttctggagcaggaggttgtcaggacaacacatataaccaccaaggatgtgttggcctttggagttcccctttaggttcctagtgatgtggaggtttatgggtgaaaaattagtggagagggaactcctctcccccattttgtgtagagtgaaaatagcctgaagcccctactcagcagggctctgggaatgtgccttccttattttagtttcagaattgctgggaaagttaccccactggtgggtgaggatctatcctcaacctacatccagatcctatgtgctgcttgcacagaggcctttggcttttgacccaggagggccgcgaggctggagctgccctgtctttcattgagccttagcatttccctctcaggcttcctctcaagctcaaggaactcacccccagataagaagctggtgcctcttgtctctctcatttcagaaacggactttctcatcatgctttcctatggtgggtatgaggggccagctgataccaaccaactggcctgtatctatctatctggatttgacttgaatttttaaaatgtgtatcgtttaaaaaaaaaaatgtttgcaaattttgcacataggatcttgcactgttcattttcagtggggtgagtcttcacactaaaaacacaagcagagctcctgggaaaagagactggaagtggttcaggataaagagatccatggtgggcagggctgttaggtcacagagctctagaagcagctggacttgaacccacaatggcttgtgtaaattcgtaaatttcatggtttctaggaaaagctgcattggggtggggagacccagtttgcctcataggcagaggattctccaggaagcatggaaaatggaatgtttccatgctttacagtgctgggagagaggggagatgtgggcaggaccttttggaaggatgtttattctctgtggttaaagaaatgctgagaatttctagcatgtgaagcacttgggggcagcaggccttggcacggtgctgcatccttctactgctccctccaggtctgggggcttttatccaccttgaatccctatcctcctctttgtagttgtcggtctcactgataacagctccagaaaaaaagacaaggctccccctctgacccttcctgttggtatttatgaaatctcaaagagatgagccaccttggcttccaatatggcaagagggtgctgggagaaggtgaagatcagtctaagctgccacggtgatgagaccttctcattatttaactcttgatggcatttcccttctgagtgaagatttgaaatatgattgattagaattgtgctcttgatggctgggaatttagaaattttattttaagagttatttcattttcatcctaagagtgatgggagagaaatgtccaaaagagatctgctgatctgctgagaatttcaaacaaacaaaaaaataatctctatgtatgtgttggataaagtctacagactgactaacatgcattagcaaatggagcatcagtaggtagcaacatgataatttatgtaactgatagcttctgtccttattagtacacttaacatttgagactagtatttattgatccaggcaaagtaattaattaatcatgcttgggcttactttttcagtttgtaaggttaagcatatgtgcatgcatgcgtgtgtatataaatgccttttccatatcttaaatgtccctgatgaggagagcagtcatcaattaaatatataagctcttaaaatgagaatggaagtgtcagtatagacccagtgtacttaagtgctgatgactgttagccagtttacaactttttaccatcgatgtacacatttgatatttgtgcagtaaatagactgtacctataaaaaattttattgatgtttatggtcatgttagctatcagagagctattggagtgagagctgaggtgtccttaaccactttttctctcctagattcattttcattatttatgctaggattttcttatggttgacatttgatgacaggaagcaatcatgactcttcaagtgagctcacagaaacctttcatgttgtctgtttccaaaatggattcaataaacaacattttgtccatgttacc

SEQ ID NO: 308046 - DNA, 2141 bp, Homo sapiens
aaagaggggggaggaaaaaaaaaatttgggggttttgggggtttttttgggggggggcccccccccctttttttggaagtttcccctttaggttcctagtgatgtggaggtttatgggtgaaaaattagtggagagggaactcctctcccccattttgtgtagagtgaaaatagcctgaagcccctactcagcagggctctgggaatgtgccttccttattttagtttcagaattgctgggaaagttaccccactggtgggtgaggatctatcctcaacctacatccagatcctatgtgctgcttgcacagaggcctttggcttttgacccaggagggccgcgaggctggagctgccctgtctttcattgagccttagcatttccctctcaggcttcctctcaagctcaaggaactcacccccagataagaagctggtgcctcttgtctctctcatttcagaaacggactttctcatcatgctttcctatggtgggtatgaggggccagctgataccaaccaactggcctgtatctatctatctggatttgacttgaatttttaaaatgtgtatcgtttaaaaaaaaaaatgtttgcaaattttgcacataggatcttgcactgttcattttcagtggggtgagtcttcacactaaaaacacaagcagagctcctgggaaaagagactggaagtggttcaggataaagagatccatggtgggcagggctgttaggtcacagagctctagaagcagctggacttgaacccacaatggcttgtgtaaattcgtaaatttcatggtttctaggaaaagctgcattggggtggggagacccagtttgcctcataggcagaggattctccaggaagcatggaaaatggaatgtttccatgctttacagtgctgggagagaggggagatgtgggcaggaccttttggaaggatgtttattctctgtggttaaagaaatgctgagaatttctagcatgtgaagcacttgggggcagcaggccttggcacggtgctgcatccttctactgctccctccaggtctgggggcttttatccaccttgaatccctatcctcctctttgtagttgtcggtctcactgataacagctccagaaaaaaagacaaggctccccctctgacccttcctgttggtatttatgaaatctcaaagagatgagccaccttggcttccaatatggcaagagggtgctgggagaaggtgaagatcagtctaagctgccacggtgatgagaccttctcattatttaactcttgatggcatttcccttctgagtgaagatttgaaatatgattgattagaattgtgctcttgatggctgggaatttagaaattttattttaagagttatttcattttcatcctaagagtgatgggagagaaatgtccaaaagagatctgctgatctgctgagaatttcaaacaaacaaaaaaataatctctatgtatgtgttggataaagtctacagactgactaacatgcattagcaaatggagcatcagtaggtagcaacatgataatttatgtaactgatagcttctgtccttattagtacacttaacatttgagactagtatttattgatccaggcaaagtaattaattaatcatgcttgggcttactttttcagtttgtaaggttaagcatatgtgcatgcatgcgtgtgtatataaatgccttttccatatcttaaatgtccctgatgaggagagcagtcatcaattaaatatataagctcttaaaatgagaatggaagtgtcagtatagacccagtgtacttaagtgctgatgactgttagccagtttacaactttttaccatcgatgtacacatttgatatttgtgcagtaaatagactgtacctataaaaaattttattgatgtttatggtcatgttagctatcagagagctattggagtgagagctgaggtgtccttaaccactttttctctcctagattcattttcattatttatgctaggattttcttatggttgacatttgatgacaggaagcaatcatgactcttcaagtgagctcacagaaacctttcatgttgtctgtttccaaaatggattcaataaacaacattttgtccatgttacc

SEQ ID NO: 308047 - DNA, 641 bp, Homo sapiens
  misc_feature (605)..(605): n is a, c, g, or t
  misc_feature (627)..(627): n is a, c, g, or t
catgcacagttctaattgcagtgacccatgacaagtgactaaggcttcaggcctcagtttccttcatcctaactgcaaggatgctgcctgccagcaacacagccttgtacattggaggaggacaatcaggatttgttgagtgagaacctgctggtcatggcaatgaacactgacctttgtgtatcttggctgttcattttccagagtgttcacgagcccacaggcccaagtgagagttatttgcaactggaggagctggtgaagcaagtggtttctcctttcctcggcatcagcggggaccgtagcttctcaggccccacgtacacgctgggtaaggagtgcagctctcaagttgtcaagaggcccagtgatcatgataccagcactgtttaactgagcactgtttaactgagcactgataccagcactgtttaactgagcacagccttttgcttcctgtgcgggtcagtgcaaatccgtgcatcttaagcactcacattcctggcctctggaggttgcagtaaccttctcccccttgatgattcctccccaaggaccgatactgtgcctttgcggtggtgcttgtctgatccacataatgcacncagggaactcgaacccagtgtnaaggatcctgtaga

SEQ ID NO: 308048 - DNA, 901 bp, Homo sapiens
agagcgcgacggggagaaccatccaggtcgctcatttctctccggtgagaaaacttcctcgggaagaccggaaactttttcctaggcgcgcggagtctggggcggaggcgagcggcgggtgtgcgcgactcggggtgattcacgccggggaccccaaggagaagaggcaattcggacataaagagaaacatcaagggcatgagtgcacagaggaaagaccatgtgacggcatggctacaaggcagccatctgtaaaccaaggagagagaccccaaaggaaatcaaccctgctgacaccttgatcgtggacttctagcctccagaactatgtagaaactgcagctcagagatgtccaaggtcacactgtgagtttattggtttcttgtggctgctataacaaatgaccacagccttcatggcttcaaacaacagaaatttattctttcatggttctggaggccataagtgcagaattaaggtggggcagggctgtattccctctaggggggaatctgcttcttttctctttcagctcctggtggctgcattatccagttcctgcgtctgtctccatatcaccttcttctctatgcgtgtctgtgtcttctcctcttctgtctctagtaacttctgcatcccctttataaggacacatgtgattgcgtttatggcccacctggataatctgggaccagcttctcttctcaaaattcttatctgaattgcatcttttgccatataagataatattcacaggttttggtgacaagtgtatgcatctttgtggggggtggggagatgtttttctgcctaccacagtgagtgaatggcaaagtgaccactgattttagggtttatctgcccccagagctctgagtgatacacatttgtggctgtaca

SEQ ID NO: 308049 - DNA, 587 bp, Homo sapiens
ggaattcggccattatggtcggggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcaactcggcaggctctgcagctgagctccagctcagcctggaacaggcggctgttgaagagtgaacttggatcattcattacagactattttcagaagaggcaattcggacataaagagaaacatcaagggcatgagtgcacagaggaaagaccatgtgacggcatggctacaaggcagccatctgtaaaccaaggagagagaccccaaaggaaatcaaccctgctgacaccttgatcgtggacttctagcctccagaactgaagtggtgacaccagcctgactcgggtgccttttctctcagcctccactgcacctgtgtctagcacctatacagttccaggaaccatgcaaagtacttcatagacaatctttctggtcatcacagctctccaaggtaac

SEQ ID NO: 308050 - DNA, 3839 bp, Homo sapiens
ggtcagtgagtggcaagccaggcccagagatctctgcgcccgttggaacatccccttctcgggaaggctggaaggccatggtcattcacctctccccagcaaggtgggacctgccctggaagaagaaaccagaccaggtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcaactcggcaggctctgcagctgagctccagctcagcctggaacagcgttcagactgctgtgatcaacgttttcaaagggggtggcttgcaaagcaacgagctctatgccctgaacgaaaacatcaggcggctgttgaagagtgaacttggatcattcattacagactattttcagaaccagcttcttgcaaaaggactgttctttgtggaggagaagatcaagctgtgtgaaggtgaaaatcgcattgaggttctggctgaagtctgggaccacttcttcactgagactctccctaccctgcaggcaatattttatccagttcagggccaggagctgactatccgccagatctccctgctgggcttccgagacctagtcttgctgaaggtgaagctgggtgacctgctgctgctggcccagtccaagctgccctcgtccattgtccagatgttgctcatcctgcagagtgttcacgagcccacaggcccaagtgagagttatttgcaactggaggagctggtgaagcaagtggtttctcctttcctcggcatcagcggggaccgtagcttctcaggccccacgtacacgctggccaggcggcactccagggtccggcccaaggtgactgtcctgaactatgcctccccgataaccgcagtcagccggccactgaatgagatggtcttgaccccactgacagagcaggagggggaagcctacctggagaagtgtggcagcgtgcggcggcacacggtggccaatgcccactcggacatccagctgctggccatggccaccatgatgcactcgggcctgggggaggaggccagcagtgagaacaagtgcctgctcctgccacccagcttccccccgccccaccggcagtgctccagtgagcccaacatcaccgacaaccctgacggactggaggagggggccaggggcagccaggagggctcggagctgaactgtgcttccctcagctgagtcgccacccctgggcctttccatctcctgttttgcaaccaggatgaggacccctccatctccgtggattactgaggggggctcttgctttatgcgatgctgccttatttcctttagggtactgtcctggtcaaaatgacctaaggggaaaccgttgttgtaaacctctttattttggtgactgtgaccacttctttgtagccaccaattgtagtgaccagttgcctaatggtcactttctgactccagccttgccagcctgactcagatcctcatctctgggcctttctccctccgatgttggactgcctgatgctcccaatgacatatccaatgctcctggcatttctggagcaggaggttgtcaggacaacacatataaccaccaaggatgtgttggcctttggagttcccctttaggttcctagtgatgtggaggtttatgggtgaaaaattagtggagagggaactcctctcccccattttgtgtagagtgaaaatagcctgaagcccctactcagcagggctctgggaatgtgccttccttattttagtttcagaattgctgggaaagttaccccactggtgggtgaggatctatcctcaacctacatccagatcctatgtgctgcttgcacagaggcctttggcttttgacccaggagggccgcgaggctggagctgccctgtctttcattgagccttagcatttccctctcaggcttcctctcaagctcaaggaactcacccccagataagaagctggtgcctcttgtctctctcatttcagaaacggactttctcatcatgctttcctatggtgggtatgaggggccagctgataccaaccaactggcctgtatctatctatctggatttgacttgaatttttaaaatgtgtatcgtttaaaaaaaaaaatgtttgcaaattttgcacataggatcttgcactgttcattttcagtggggtgagtcttcacactaaaaacacaagcagagctcctgggaaaagagactggaagtggttcaggataaagagatccatggtgggcagggctgttaggtcacagagctctagaagcagctggacttgaacccacaatggcttgtgtaaattcgtaaatttcatggtttctaggaaaagctgcattggggtggggagacccagtttgcctcataggcagaggattctccaggaagcatggaaaatggaatgtttccatgctttacagtgctgggagagaggggagatgtgggcaggaccttttggaaggatgtttattctctgtggttaaagaaatgctgagaatttctagcatgtgaagcacttgggggcagcaggccttggcacggtgctgcatccttctactgctccctccaggtctgggggcttttatccaccttgaatccctatcctcctctttgtagttgtcggtctcactgataacagctccagaaaaaaagacaaggctccccctctgacccttcctgttggtatttatgaaatctcaaagagatgagccaccttggcttccaatatggcaagagggtgctgggagaaggtgaagatcagtctaagctgccacggtgatgagaccttctcattatttaactcttgatggcatttcccttctgagtgaagatttgaaatatgattgattagaattgtgctcttgatggctgggaatttagaaattttattttaagagttatttcattttcatcctaagagtgatgggagagaaatgtccaaaagagatctgctgatctgctgagaatttcaaacaaacaaaaaaataatctctatgtatgtgttggataaagtctacagactgactaacatgcattagcaaatggagcatcagtaggtagcaacatgataatttatgtaactgatagcttctgtccttattagtacacttaacatttgagactagtatttattgatccaggcaaagtaattaattaatcatgcttgggcttactttttcagtttgtaaggttaagcatatgtgcatgcatgcgtgtgtatataaatgccttttccatatcttaaatgtccctgatgaggagagcagtcatcaattaaatatataagctcttaaaatgagaatggaagtgtcagtatagacccagtgtacttaagtgctgatgactgttagccagtttacaactttttaccatcgatgtacacatttgatatttgtgcagtaaatagactgtacctataaaaaattttattgatgtttatggtcatgttagctatcagagagctattggagtgagagctgaggtgtccttaaccactttttctctcctagattcattttcattatttatgctaggattttcttatggttgacatttgatgacaggaagcaatcatgactcttcaagtgagctcacagaaacctttcatgttgtctgtttccaaaatggattcaataaacaacattttgtccatgttacc

SEQ ID NO: 308051 - DNA, 3863 bp, Homo sapiens
agagcgcgacggggagaaccatccaggtcgctcatttctctccggtgagaaaacttcctcgggaagaccggaaactttttcctaggcgcgcggagtctggggcggaggcgagcggcgggtgtgcgcgactcggggtgattcacgccggggaccccaaggaggtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcaactcggcaggctctgcagctgagctccagctcagcctggaacagcgttcagactgctgtgatcaacgttttcaaagggggtggcttgcaaagcaacgagctctatgccctgaacgaaaacatcaggcggctgttgaagagtgaacttggatcattcattacagactattttcagaaccagcttcttgcaaaaggactgttctttgtggaggagaagatcaagctgtgtgaaggtgaaaatcgcattgaggttctggctgaagtctgggaccacttcttcactgagactctccctaccctgcaggcaatattttatccagttcagggccaggagctgactatccgccagatctccctgctgggcttccgagacctagtcttgctgaaggtgaagctgggtgacctgctgctgctggcccagtccaagctgccctcgtccattgtccagatgttgctcatcctgcagagtgttcacgagcccacaggcccaagtgagagttatttgcaactggaggagctggtgaagcaagtggtttctcctttcctcggcatcagcggggaccgtagcttctcaggccccacgtacacgctggccaggcggcactccagggtccggcccaaggtgactgtcctgaactatgcctccccgataaccgcagtcagccggccactgaatgagatggtcttgaccccactgacagagcaggagggggaagcctacctggagaagtgtggcagcgtgcggcggcacacggtggccaatgcccactcggacatccagctgctggccatggccaccatgatgcactcgggcctgggggaggaggccagcagtgagaacaagtgcctgctcctgccacccagcttccccccgccccaccggcagtgctccagtgagcccaacatcaccgacaaccctgacggactggaggagggggccaggggcagccaggagggctcggagctgaactgtgcttccctcagctgagtcgccacccctgggcctttccatctcctgttttgcaaccaggatgaggacccctccatctccgtggattactgaggggggctcttgctttatgcgatgctgccttatttcctttagggtactgtcctggtcaaaatgacctaaggggaaaccgttgttgtaaacctctttattttggtgactgtgaccacttctttgtagccaccaattgtagtgaccagttgcctaatggtcactttctgactccagccttgccagcctgactcagatcctcatctctgggcctttctccctccgatgttggactgcctgatgctcccaatgacatatccaatgctcctggcatttctggagcaggaggttgtcaggacaacacatataaccaccaaggatgtgttggcctttggagttcccctttaggttcctagtgatgtggaggtttatgggtgaaaaattagtggagagggaactcctctcccccattttgtgtagagtgaaaatagcctgaagcccctactcagcagggctctgggaatgtgccttccttattttagtttcagaattgctgggaaagttaccccactggtgggtgaggatctatcctcaacctacatccagatcctatgtgctgcttgcacagaggcctttggcttttgacccaggagggccgcgaggctggagctgccctgtctttcattgagccttagcatttccctctcaggcttcctctcaagctcaaggaactcacccccagataagaagctggtgcctcttgtctctctcatttcagaaacggactttctcatcatgctttcctatggtgggtatgaggggccagctgataccaaccaactggcctgtatctatctatctggatttgacttgaatttttaaaatgtgtatcgtttaaaaaaaaaaatgtttgcaaattttgcacataggatcttgcactgttcattttcagtggggtgagtcttcacactaaaaacacaagcagagctcctgggaaaagagactggaagtggttcaggataaagagatccatggtgggcagggctgttaggtcacagagctctagaagcagctggacttgaacccacaatggcttgtgtaaattcgtaaatttcatggtttctaggaaaagctgcattggggtggggagacccagtttgcctcataggcagaggattctccaggaagcatggaaaatggaatgtttccatgctttacagtgctgggagagaggggagatgtgggcaggaccttttggaaggatgtttattctctgtggttaaagaaatgctgagaatttctagcatgtgaagcacttgggggcagcaggccttggcacggtgctgcatccttctactgctccctccaggtctgggggcttttatccaccttgaatccctatcctcctctttgtagttgtcggtctcactgataacagctccagaaaaaaagacaaggctccccctctgacccttcctgttggtatttatgaaatctcaaagagatgagccaccttggcttccaatatggcaagagggtgctgggagaaggtgaagatcagtctaagctgccacggtgatgagaccttctcattatttaactcttgatggcatttcccttctgagtgaagatttgaaatatgattgattagaattgtgctcttgatggctgggaatttagaaattttattttaagagttatttcattttcatcctaagagtgatgggagagaaatgtccaaaagagatctgctgatctgctgagaatttcaaacaaacaaaaaaataatctctatgtatgtgttggataaagtctacagactgactaacatgcattagcaaatggagcatcagtaggtagcaacatgataatttatgtaactgatagcttctgtccttattagtacacttaacatttgagactagtatttattgatccaggcaaagtaattaattaatcatgcttgggcttactttttcagtttgtaaggttaagcatatgtgcatgcatgcgtgtgtatataaatgccttttccatatcttaaatgtccctgatgaggagagcagtcatcaattaaatatataagctcttaaaatgagaatggaagtgtcagtatagacccagtgtacttaagtgctgatgactgttagccagtttacaactttttaccatcgatgtacacatttgatatttgtgcagtaaatagactgtacctataaaaaattttattgatgtttatggtcatgttagctatcagagagctattggagtgagagctgaggtgtccttaaccactttttctctcctagattcattttcattatttatgctaggattttcttatggttgacatttgatgacaggaagcaatcatgactcttcaagtgagctcacagaaacctttcatgttgtctgtttccaaaatggattcaataaacaacattttgtccatgttacc

SEQ ID NO: 308052 - DNA, 3610 bp, Homo sapiens
cggctgtgggagctccgcggccgaagcgtttgttgactcgcgctggagaggaaccgaggctggacgggaccccatctgagggcagagctgggggaggagggagggacggagggagggagagctgggctcagcgaccttccccgattccaagcaactcggcaggctctgcagctgagctccagctcagcctggaacagcgttcagactgctgtgatcaacgttttcaaagggggtggcttgcaaagcaacgagctctatgccctgaacgaaaacatcaggcggctgttgaagagtgaacttggatcattcattacagactattttcagaaccagcttcttgcaaaaggactgttctttgtggaggagaagatcaagctgtgtgaaggtgaaaatcgcattgaggttctggctgaagtctgggaccacttcttcactgagactctccctaccctgcaggcaatattttatccagttcagggccaggagctgactatccgccagatctccctgctgggcttccgagacctagtcttgctgaaggtgaagctgggtgacctgctgctgctggcccagtccaagctgccctcgtccattgtccagatgttgctcatcctgcagagtgttcacgagcccacaggcccaagtgagagttatttgcaactggaggagctggtgaagcaagtggtttctcctttcctcggcatcagcggggaccgtagcttctcaggccccacgtacacgctggccaggcggcactccagggtccggcccaaggtgactgtcctgaactatgcctccccgataaccgcagtcagccggccactgaatgagatggtcttgaccccactgacagagcaggagggggaagcctacctggagaagtgtggcagcgtgcggcggcacacggtggccaatgcccactcggacatccagctgctggccatggccaccatgatgcactcgggcctgggggaggaggccagcagtgagaacaagtgcctgctcctgccacccagcttccccccgccccaccggcagtgctccagtgagcccaacatcaccgacaaccctgacggactggaggagggggccaggggcagccaggagggctcggagctgaactgtgcttccctcagctgagtcgccacccctgggcctttccatctcctgttttgcaaccaggatgaggacccctccatctccgtggattactgaggggggctcttgctttatgcgatgctgccttatttcctttagggtactgtcctggtcaaaatgacctaaggggaaaccgttgttgtaaacctctttattttggtgactgtgaccacttctttgtagccaccaattgtagtgaccagttgcctaatggtcactttctgactccagccttgccagcctgactcagatcctcatctctgggcctttctccctccgatgttggactgcctgatgctcccaatgacatatccaatgctcctggcatttctggagcaggaggttgtcaggacaacacatataaccaccaaggatgtgttggcctttggagttcccctttaggttcctagtgatgtggaggtttatgggtgaaaaattagtggagagggaactcctctcccccattttgtgtagagtgaaaatagcctgaagcccctactcagcagggctctgggaatgtgccttccttattttagtttcagaattgctgggaaagttaccccactggtgggtgaggatctatcctcaacctacatccagatcctatgtgctgcttgcacagaggcctttggcttttgacccaggagggccgcgaggctggagctgccctgtctttcattgagccttagcatttccctctcaggcttcctctcaagctcaaggaactcacccccagataagaagctggtgcctcttgtctctctcatttcagaaacggactttctcatcatgctttcctatggtgggtatgaggggccagctgataccaaccaactggcctgtatctatctatctggatttgacttgaatttttaaaatgtgtatcgtttaaaaaaaaaaatgtttgcaaattttgcacataggatcttgcactgttcattttcagtggggtgagtcttcacactaaaaacacaagcagagctcctgggaaaagagactggaagtggttcaggataaagagatccatggtgggcagggctgttaggtcacagagctctagaagcagctggacttgaacccacaatggcttgtgtaaattcgtaaatttcatggtttctaggaaaagctgcattggggtggggagacccagtttgcctcataggcagaggattctccaggaagcatggaaaatggaatgtttccatgctttacagtgctgggagagaggggagatgtgggcaggaccttttggaaggatgtttattctctgtggttaaagaaatgctgagaatttctagcatgtgaagcacttgggggcagcaggccttggcacggtgctgcatccttctactgctccctccaggtctgggggcttttatccaccttgaatccctatcctcctctttgtagttgtcggtctcactgataacagctccagaaaaaaagacaaggctccccctctgacccttcctgttggtatttatgaaatctcaaagagatgagccaccttggcttccaatatggcaagagggtgctgggagaaggtgaagatcagtctaagctgccacggtgatgagaccttctcattatttaactcttgatggcatttcccttctgagtgaagatttgaaatatgattgattagaattgtgctcttgatggctgggaatttagaaattttattttaagagttatttcattttcatcctaagagtgatgggagagaaatgtccaaaagagatctgctgatctgctgagaatttcaaacaaacaaaaaaataatctctatgtatgtgttggataaagtctacagactgactaacatgcattagcaaatggagcatcagtaggtagcaacatgataatttatgtaactgatagcttctgtccttattagtacacttaacatttgagactagtatttattgatccaggcaaagtaattaattaatcatgcttgggcttactttttcagtttgtaaggttaagcatatgtgcatgcatgcgtgtgtatataaatgccttttccatatcttaaatgtccctgatgaggagagcagtcatcaattaaatatataagctcttaaaatgagaatggaagtgtcagtatagacccagtgtacttaagtgctgatgactgttagccagtttacaactttttaccatcgatgtacacatttgatatttgtgcagtaaatagactgtacctataaaaaattttattgatgtttatggtcatgttagctatcagagagctattggagtgagagctgaggtgtccttaaccactttttctctcctagattcattttcattatttatgctaggattttcttatggttgacatttgatgacaggaagcaatcatgactcttcaagtgagctcacagaaacctttcatgttgtctgtttccaaaatggattcaataaacaacattttgtccatgttacc

SEQ ID NO: 308053 - DNA, 3051 bp, Homo sapiens
gatccaggtccccaatgtaaggatgccgaggatggacgttatgcaggtgttgcattctctcttggcgggtttcgatagaggagctgtcttcttgcttggactccggtgcagttggtgatgaattgccagtagtaagtgacatgcctgtttcagctatggcgctcctgcccaagggtctggcccacttgccaatgtggatccaggtcccgacaggttgacttgtcctgaactatgcctccccgataaccgcagtcagccggccactgaatgagatggtcttgaccccactgacagagcaggagggggaagcctacctggagaagtgtggcagcgtgcggcggcacacggtggccaatgcccactcggacatccagctgctggccatggccaccatgatgcactcgggcctgggggaggaggccagcagtgagaacaagtgcctgctcctgccacccagcttccccccgccccaccggcagtgctccagtgagcccaacatcaccgacaaccctgacggactggaggagggggccaggggcagccaggagggctcggagctgaactgtgcttccctcagctgagtcgccacccctgggcctttccatctcctgttttgcaaccaggatgaggacccctccatctccgtggattactgaggggggctcttgctttatgcgatgctgccttatttcctttagggtactgtcctggtcaaaatgacctaaggggaaaccgttgttgtaaacctctttattttggtgactgtgaccacttctttgtagccaccaattgtagtgaccagttgcctaatggtcactttctgactccagccttgccagcctgactcagatcctcatctctgggcctttctccctccgatgttggactgcctgatgctcccaatgacatatccaatgctcctggcatttctggagcaggaggttgtcaggacaacacatataaccaccaaggatgtgttggcctttggagttcccctttaggttcctagtgatgtggaggtttatgggtgaaaaattagtggagagggaactcctctcccccattttgtgtagagtgaaaatagcctgaagcccctactcagcagggctctgggaatgtgccttccttattttagtttcagaattgctgggaaagttaccccactggtgggtgaggatctatcctcaacctacatccagatcctatgtgctgcttgcacagaggcctttggcttttgacccaggagggccgcgaggctggagctgccctgtctttcattgagccttagcatttccctctcaggcttcctctcaagctcaaggaactcacccccagataagaagctggtgcctcttgtctctctcatttcagaaacggactttctcatcatgctttcctatggtgggtatgaggggccagctgataccaaccaactggcctgtatctatctatctggatttgacttgaatttttaaaatgtgtatcgtttaaaaaaaaaaatgtttgcaaattttgcacataggatcttgcactgttcattttcagtggggtgagtcttcacactaaaaacacaagcagagctcctgggaaaagagactggaagtggttcaggataaagagatccatggtgggcagggctgttaggtcacagagctctagaagcagctggacttgaacccacaatggcttgtgtaaattcgtaaatttcatggtttctaggaaaagctgcattggggtggggagacccagtttgcctcataggcagaggattctccaggaagcatggaaaatggaatgtttccatgctttacagtgctgggagagaggggagatgtgggcaggaccttttggaaggatgtttattctctgtggttaaagaaatgctgagaatttctagcatgtgaagcacttgggggcagcaggccttggcacggtgctgcatccttctactgctccctccaggtctgggggcttttatccaccttgaatccctatcctcctctttgtagttgtcggtctcactgataacagctccagaaaaaaagacaaggctccccctctgacccttcctgttggtatttatgaaatctcaaagagatgagccaccttggcttccaatatggcaagagggtgctgggagaaggtgaagatcagtctaagctgccacggtgatgagaccttctcattatttaactcttgatggcatttcccttctgagtgaagatttgaaatatgattgattagaattgtgctcttgatggctgggaatttagaaattttattttaagagttatttcattttcatcctaagagtgatgggagagaaatgtccaaaagagatctgctgatctgctgagaatttcaaacaaacaaaaaaataatctctatgtatgtgttggataaagtctacagactgactaacatgcattagcaaatggagcatcagtaggtagcaacatgataatttatgtaactgatagcttctgtccttattagtacacttaacatttgagactagtatttattgatccaggcaaagtaattaattaatcatgcttgggcttactttttcagtttgtaaggttaagcatatgtgcatgcatgcgtgtgtatataaatgccttttccatatcttaaatgtccctgatgaggagagcagtcatcaattaaatatataagctcttaaaatgagaatggaagtgtcagtatagacccagtgtacttaagtgctgatgactgttagccagtttacaactttttaccatcgatgtacacatttgatatttgtgcagtaaatagactgtacctataaaaaattttattgatgtttatggtcatgttagctatcagagagctattggagtgagagctgaggtgtccttaaccactttttctctcctagattcattttcattatttatgctaggattttcttatggttgacatttgatgacaggaagcaatcatgactcttcaagtgagctcacagaaacctttcatgttgtctgtttccaaaatggattcaataaacaacattttgtccatgttacc

SEQ ID NO: 308054 - DNA, 1284 bp, Homo sapiens
  misc_feature (1248)..(1248): n is a, c, g, or t
  misc_feature (1270)..(1270): n is a, c, g, or t
ggtcagtgagtggcaagccaggcccagagatctctgcgcccgttggaacatccccttctcgggaaggctggaaggccatggtcattcacctctccccagcaaggtgggacctgccctggaagaagaaaccagaccaggtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcaactcggcaggctctgcagctgagctccagctcagcctggaacagcgttcagactgctgtgatcaacgttttcaaagggggtggcttgcaaagcaacgagctctatgccctgaacgaaaacatcaggcggctgttgaagagtgaacttggatcattcattacagactattttcagaaccagcttcttgcaaaaggactgttctttgtggaggagaagatcaagctgtgtgaaggtgaaaatcgcattgaggttctggctgaagtctgggaccacttcttcactgagactctccctaccctgcaggcaatattttatccagttcagggccaggagctgactatccgccagatctccctgctgggcttccgagacctagtcttgctgaaggtgaagctgggtgacctgctgctgctggcccagtccaagctgccctcgtccattgtccagatgttgctcatcctgcagagtgttcacgagcccacaggcccaagtgagagttatttgcaactggaggagctggtgaagcaagtggtttctcctttcctcggcatcagcggggaccgtagcttctcaggccccacgtacacgctgggtaaggagtgcagctctcaagttgtcaagaggcccagtgatcatgataccagcactgtttaactgagcactgtttaactgagcactgataccagcactgtttaactgagcacagccttttgcttcctgtgcgggtcagtgcaaatccgtgcatcttaagcactcacattcctggcctctggaggttgcagtaaccttctcccccttgatgattcctccccaaggaccgatactgtgcctttgcggtggtgcttgtctgatccacataatgcacncagggaactcgaacccagtgtnaaggatcctgtaga

SEQ ID NO: 308055 - DNA, 1217 bp, Homo sapiens
ataggaatttacttgttttccactcaaggaaaagaagtaaattcctatgtcagagtaaccgaggtggttgaagaataggaatttacttcttttccttgagtggaaaacactttagaaaataataacaaacattattataaactaatatatgtgagagtacttagttgaaacaaaaaggaattttagtagacagtattatattatctttgaaaatcaaggagaagtttatgcaactgaaaatgtttacacactgtgctgcaatctactgtttgtgaatgtcaatgtattatcaggaaacatgtctatacgatcgcagagttgtatttcctcacaaacttctttacgaagagtgaaatatgtttttgtacctctcagtttcagtcagggacatattttgtgcaatatttctgtgattgtgcctatgcgtgatgaatgaatgcatttcaatcatacattgcctaaatcataacttgatgatgcttgggaaagaatcaacagttaaaacttcatgaagttctaatgtctgtgttccaaaacacatcacattattaggttgtagggagatatgtatgtgtgctccctggggtggggagttttctagttactagaccatctccatttttagcacttggcagcctcatgatccttttataaataggagattaacaggagagcagcaatacgattttgccaatggaataacagatttgccggcattcactgaaagagggcagatattgggtccttgtgacttcaactgactcttccgaattgtatgaatttatcaatgtattagataaacccagtttcagaataataaagaaaaaatattagaccaaataatgtggctaatagtggtatgatttctagcccgtgggtttaaaactgtatcctaaagagtcattttaaaataatataaatatttaaaagtgtaactgctatctttatgttctgaaataagttaaaacattttaaaatatgaatactgtagtttaaaagaaagaaatggtgggaaggaaaagtagagaaagaaatgccaattccagtccaaagctttgtttgccaagttttcttagaatgaattttaccaatgtatgggttcttgttaacagaatgtgtaacagaaatactgaaagacttttgcctaaagtggcattattgactgctggtgtgatgctactgtaatgtgataaattattaaattgttgcaaagtgct

SEQ ID NO: 308056 - DNA, 5258 bp, Homo sapiens
gggtggattaattttttttttttgacgttcttagaacagtgcctgacttaattctacttcatagggttgatgtaattttgagacttaaataagttgatactaaaataccacttagtgtcccgaacactgtttgacattttagtatcaaccaagtctcaaggttacttcaatcctgtgaactagagccaaggcacctccagtggcctttcagaagttccatttccactcccgcctcatctcctaattctatctccccgttctctttactcgagccctcctggccttgcccttccttaggcctgatacgcacctatctgaagacctttgcactgcactccagcctggaaggcagagagagactccgtttcaaaaaagaaaagaattctgggtttgaatcctgcctctccgtctgctagggatatgatttagggcaagttgcttgagctctttgggcctctgttttcacgtctgtatgatagaggtggtattgtttgacttgtatttgtgaagtttcaatgagattgataattgtcgattttatgttaatccctagtacatggcctgctgtcaacacccaggacacccaggatatggtctttgctgtttgattttcctcatccccagtctcaaggggaagccaggacaatgagaacagccacttcccatcaggagtcactgcaaggcccccagggtgggatggtggggagataagaaccgtgagagaagttggcacaaaggagttatgggacaaagggtccaagataggcagaaaagaaaatgttgccagttgatggggaagaaaggaagtcggagggctcagacactgagggggacagaacatctccatgtgcagtctcatctcttatagtcagcaacaggtatccacggggagggccctacatcatctgctaccctgaaggatctggaggtaggaggctctgggcggaggtgcagtgaccccgcaggccagccctccaacctcctcccgcagcggggactgggtgcccctctgccagctgagacagcccacacacaacccagccctaatgatcgttctctctacctctcccccaagtcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacaggagaagaggcttcagcagctggccgagccacagagcgacttggaggagctgaagcacgagaacaagagcgcactgcagttggagcagcaagtaaaggagctgcaggagaagctgggccaggtgacggagacgctcacctcggctgagaaggagccagaggcagcagtcccagcctcagggactgggggcgagtctagcggccttatggacctcctggaggagaaggtggacctgagggagcatgtggagaaactggaacttggattcatccagtaccggagagagagatgccatcagaaagtacatcgccttctaacagagccaggggacagtgccaaagatgcgtcaccgggaggaggccatcatcaggctggcccaggacgaggaggagaggaaggtgaagctgttggagctgcaggagatggtgttgcggcttgtggcagctacagcgaggggcacggcaaattcctggccgctgcccggaaccctgctgctgaacccagtccaggagccccagccccccaggagctcggggctgccgacaagcatggtgatctttgtgaggcgagcctcaccaacagcgtggagcctgcacaaggagaagccagggagggttcttcccaggacaaccctactgcacagccagtcgtgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtgcctctcactgatgttcactctggcatcctttagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttttaatgttattgcagcatggatgttcattacagaattcagataaaatttgctaatgttctgctatgatgtttgatctcatcttaatcacagtgagctcttccatagctcaatatgcggtttgccctcaagtgtgcactgtttattactttgtaatatgccactatgagtactgacacttagagctgtttaaaggccgagaactggaaacagcctttcctccattttctgtgtattggtgatgggagtgataaccttttgggggagctttctaaatctcgcagaagaggaaagtggcctgctctggcaggtatgtgcaggatacagtgtgtttcatctgttccggtgccaagaatgagcactgtactgtggcagttccctttggatttgtatgtgctctgggctcatgaagatattgcatcgtgagctgcagcagttgcactctttttcagtgacctaaaaatggcttatttccgaggaatgaaaggctgccatcgttggctgtggatgtggaaaacctttcctagcttagagcatttgtatctacaatacattttaaagtcagagttcgtgttccctgttttaatcacatgactacctgtcccagtacacgaaagggcgctggttggcattcttcttaatgtatttagtaaagatcataagacatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaaataataacaaacattattataaactaatatatgtgagagtacttagttgaaacaaaaaggaattttagtagacagtattatattatctttgaaaatcaaggagaagtttatgcaactgaaaatgtttacacactgtgctgcaatctactgtttgtgaatgtcaatgtattatcaggaaacatgtctatacgatcgcagagttgtatttcctcacaaacttctttacgaagagtgaaatatgtttttgtacctctcagtttcagtcagggacatattttgtgcaatatttctgtgattgtgcctatgcgtgatgaatgaatgcatttcaatcatacattgcctaaatcataacttgatgatgcttgggaaagaatcaacagttaaaacttcatgaagttctaatgtctgtgttccaaaacacatcacattattaggttgtagggagatatgtatgtgtgctccctggggtggggagttttctagttactagaccatctccatttttagcacttggcagcctcatgatccttttataaataggagattaacaggagagcagcaatacgattttgccaatggaataacagatttgccggcattcactgaaagagggcagatattgggtccttgtgacttcaactgactcttccgaattgtatgaatttatcaatgtattagataaacccagtttcagaataataaagaaaaaatattagaccaaataatgtggctaatagtggtatgatttctagcccgtgggtttaaaactgtatcctaaagagtcattttaaaataatataaatatttaaaagtgtaactgctatctttatgttctgaaataagttaaaacattttaaaatatgaatactgtagtttaaaagaaagaaatggtgggaaggaaaagtagagaaagaaatgccaattccagtccaaagctttgtttgccaagttttcttagaatgaattttaccaatgtatgggttcttgttaacagaatgtgtaacagaaatactgaaagacttttgcctaaagtggcattattgactgctggtgtgatgctactgtaatgtgataaattattaaattgttgcaaagtgctgtttttgccttaaaattttattttgcgcatcttgaaaattatagtattaaaggtattgatactgtgcaaatactgggcatgcttggcatgagataatctgtttcattttcacaaaattgtagtataactatgcaagtgtttattaaaagaacacaaaataaaaaaggtatgggattaaaaaaaa

SEQ ID NO: 308057 - DNA, 5332 bp, Homo sapiens
ttggaactactgacctcaggtgatccgcccactttggcctcccgaaagtgctgggattacagtcatgagccaccatgcccagcctatttatttctgattctttaagggtgactggacgtgttgatcagcgctcgctgggatttggctgacgtgccccagccccgcctccctccccaccccacaatggcagaagaaactggacagagtaaattagctgcagccaagaaaaagttcaaagaatattggcagagaaaccgccctggtgttccagcagcagcgaagaggaacacgaaagcaaatggcagtagccctgagacggccgcttctggtggttgccactcatctgaggctgtgagtcttgcctggacaggcttttggggacagggggcccaaggagcagtagagggcaatcgttaagattgtggatggactgttgggtactggtgaaggattctggatttggccgggcacagtggctcacgcctgtaatccccacacttcgggagaccgaggcaggtggatcacaaggtcaggagatcgagaccatccaggcaaacacggtgaaatactaaaaaatacaaaaaaaaaagccgggcgtggtggcgggcgcctgcagtcccagctgctccggagtctgagggaggagaatggcgtgaacctaggaggcggagcttgcagtgagccaagatcacgccactgcactccagcctggaaggcagagagagactccgtttcaaaaaagaaaagaattctgggtttgaatcctgcctctccgtctgctagggatatgatttagggcaagttgcttgagctctttgggcctctgttttcacgtctgtatgatagaggtggtattgtttgacttgtatttgtgaagtttcaatgagattgataattgtcgattttatgttaatccctagtacatggcctgctgtcaacacccaggacacccaggatatggtctttgctgtttgattttcctcatccccagtctcaaggggaagccaggacaatgagaacagccacttcccatcaggagtcactgcaaggcccccagggtgggatggtggggagataagaaccgtgagagaagttggcacaaaggagttatgggacaaagggtccaagataggcagaaaagaaaatgttgccagttgatggggaagaaaggaagtcggagggctcagacactgagggggacagaacatctccatgtgcagtctcatctcttatagtcagcaacaggtatccacggggagggccctacatcatctgctaccctgaaggatctggaggtaggaggctctgggcggaggtgcagtgaccccgcaggccagccctccaacctcctcccgcagcggggactgggtgcccctctgccagctgagacagcccacacacaacccagccctaatgatcgttctctctacctctcccccaagtcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacaggagaagaggcttcagcagctggccgagccacagagcgacttggaggagctgaagcacgagaacaagagcgcactgcagttggagcagcaagtaaaggagctgcaggagaagctgggccaggtgacggagacgctcacctcggctgagaaggagccagaggcagcagtcccagcctcagggactgggggcgagtctagcggccttatggacctcctggaggagaaggtggacctgagggagcatgtggagaaactggaacttggattcatccagtaccggagagagagatgccatcagaaagtacatcgccttctaacagagccaggggacagtgccaaagatgcgtcaccgggaggaggccatcatcaggctggcccaggacgaggaggagaggaaggtgaagctgttggagctgcaggagatggtgttgcggcttgtggcagctacagcgaggggcacggcaaattcctggccgctgcccggaaccctgctgctgaacccagtccaggagccccagccccccaggagctcggggctgccgacaagcatggtgatctttgtgaggcgagcctcaccaacagcgtggagcctgcacaaggagaagccagggagggttcttcccaggacaaccctactgcacagccagtcgtgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtgcctctcactgatgttcactctggcatcctttagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttttaatgttattgcagcatggatgttcattacagaattcagatcttccatagctcaatatgcggtttgccctcaagtgtgcactgtttattactttgtaatatgccactatgagtactgacacttagagctgtttaaaggccgagaactggaaacagcctttcctccattttctgtgtattggtgatgggagtgataaccttttgggggagctttctaaatctcgcagaagaggaaagtggcctgctctggcaggtatgtgcaggatacagtgtgtttcatctgttccggtgccaagaatgagcactgtactgtggcagttccctttggatttgtatgtgctctgggctcatgaagatattgcatcgtgagctgcagcagttgcactctttttcagtgacctaaaaatggcttatttccgaggaatgaaaggctgccatcgttggctgtggatgtggaaaacctttcctagcttagagcatttgtatctacaatacattttaaagtcagagttcgtgttccctgttttaatcacatgactacctgtcccagtacacgaaagggcgctggttggcattcttcttaatgtatttagtaaagatcataagacatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaaataataacaaacattattataaactaatatatgtgagagtacttagttgaaacaaaaaggaattttagtagacagtattatattatctttgaaaatcaaggagaagtttatgcaactgcaggaaacatgtctatacgatcgcagagttgtatttcctcacaaacttctttacgaagagtgaaatatgtttttgtacctctcagtttcagtcagggacatattttgtgcaatatttctgtgattgtgcctatgcgtgatgaatgaatgcatttcaatcatacattgcctaaatcataacttgatgatgcttgggaaagaatcaacagttaaaacttcatgaagttctaatgtctgtgttccaaaacacatcacattattaggttgtagggagatatgtatgtgtgctccctggggtggggagttttctagttactagaccatctccatttttagcacttggcagcctcatgatccttttataaataggagattaacaggagagcagcaatacgattttgccaatggaataacagatttgccggcattcactgaaagagggcagatattgggtccttgtgacttcaactgactcttccgaattgtatgaatttatcaatgtattagataaacccagtttcagaataataaagaaaaaatattagaccaaataatgtggctaatagtggtatgatttctagcccgtgggtttaaaactgtatcctaaagagtcattttaaaataatataaatatttaaaagtgtaactgctatctttatgttctgaaataagttaaaacattttaaaatatgaatactgtagtttaaaagaaagaaatggtgggaaggaaaagtagagaaagaaatgccaattccagtccaaagctttgtttgccaagttttcttagaatgaattttaccaatgtatgggttcttgttaacagaatgtgtaacagaaatactgaaagacttttgcctaaagtggcattattgactgctggtgtgatgctactgtaatgtgataaattattaaattgttgcaaagtgct

SEQ ID NO: 308058 - DNA, 5189 bp, Homo sapiens
ttggaactactgacctcaggtgatccgcccactttggcctcccgaaagtgctgggattacagtcatgagccaccatgcccagcctatttatttctgattctttaagggtgactggacgtgttgatcagcgctcgctgggatttggctgacgtgccccagccccgcctccctccccaccccacaatggcagaagaaactggacagagtaaattagctgcagccaagaaaaagttcaaagaatattggcagagaaaccgccctggtgttccagcagcagcgaagaggaacacgaaagcaaatggcagtagccctgagacggccgcttctggtggttgccactcatctgaggctgtgagtcttgcctggacaggcttttggggacagggggcccaaggagcagtagagggcaatcgttaagattgtggatggactgttgggtactggtgaaggattctggatttggccgggcacagtggctcacgcctgtaatccccacacttcgggagaccgaggcaggtggatcacaaggtcaggagatcgagaccatccaggcaaacacggtgaaatactaaaaaatacaaaaaaaaaagccgggcgtggtggcgggcgcctgcagtcccagctgctccggagtctgagggaggagaatggcgtgaacctaggaggcggagcttgcagtgagccaagatcacgccactgcactccagcctggaaggcagagagagactccgtttcaaaaaagaaaagaattctgggtttgaatcctgcctctccgtctgctagggatatgatttagggcaagttgcttgagctctttgggcctctgttttcacgtctgtatgatagaggtggtattgtttgacttgtatttgtgaagtttcaatgagattgataattgtcgattttatgttaatccctagtacatggcctgctgtcaacacccaggacacccaggatatggtctttgctgtttgattttcctcatccccagtctcaaggggaagccaggacaatgagaacagccacttcccatcaggagtcactgcaaggcccccagggtgggatggtggggagataagaaccgtgagagaagttggcacaaaggagttatgggacaaagggtccaagataggcagaaaagaaaatgttgccagttgatggggaagaaaggaagtcggagggctcagacactgagggggacagaacatctccatgtgcagtctcatctcttatagtcagcaacagtcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacaggagaagaggcttcagcagctggccgagccacagagcgacttggaggagctgaagcacgagaacaagagcgcactgcagttggagcagcaagtaaaggagctgcaggagaagctgggccaggtgacggagacgctcacctcggctgagaaggagccagaggcagcagtcccagcctcagggactgggggcgagtctagcggccttatggacctcctggaggagaaggtggacctgagggagcatgtggagaaactggaacttggattcatccagtaccggagagagagatgccatcagaaagtacatcgccttctaacagagccaggggacagtgccaaagatgcgtcaccgggaggaggccatcatcaggctggcccaggacgaggaggagaggaaggtgaagctgttggagctgcaggagatggtgttgcggcttgtggcagctacagcgaggggcacggcaaattcctggccgctgcccggaaccctgctgctgaacccagtccaggagccccagccccccaggagctcggggctgccgacaagcatggtgatctttgtgaggcgagcctcaccaacagcgtggagcctgcacaaggagaagccagggagggttcttcccaggacaaccctactgcacagccagtcgtgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtgcctctcactgatgttcactctggcatcctttagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttttaatgttattgcagcatggatgttcattacagaattcagatcttccatagctcaatatgcggtttgccctcaagtgtgcactgtttattactttgtaatatgccactatgagtactgacacttagagctgtttaaaggccgagaactggaaacagcctttcctccattttctgtgtattggtgatgggagtgataaccttttgggggagctttctaaatctcgcagaagaggaaagtggcctgctctggcaggtatgtgcaggatacagtgtgtttcatctgttccggtgccaagaatgagcactgtactgtggcagttccctttggatttgtatgtgctctgggctcatgaagatattgcatcgtgagctgcagcagttgcactctttttcagtgacctaaaaatggcttatttccgaggaatgaaaggctgccatcgttggctgtggatgtggaaaacctttcctagcttagagcatttgtatctacaatacattttaaagtcagagttcgtgttccctgttttaatcacatgactacctgtcccagtacacgaaagggcgctggttggcattcttcttaatgtatttagtaaagatcataagacatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaaataataacaaacattattataaactaatatatgtgagagtacttagttgaaacaaaaaggaattttagtagacagtattatattatctttgaaaatcaaggagaagtttatgcaactgaaaatgtttacacactgtgctgcaatctactgtttgtgaatgtcaatgtattatcaggaaacatgtctatacgatcgcagagttgtatttcctcacaaacttctttacgaagagtgaaatatgtttttgtacctctcagtttcagtcagggacatattttgtgcaatatttctgtgattgtgcctatgcgtgatgaatgaatgcatttcaatcatacattgcctaaatcataacttgatgatgcttgggaaagaatcaacagttaaaacttcatgaagttctaatgtctgtgttccaaaacacatcacattattaggttgtagggagatatgtatgtgtgctccctggggtggggagttttctagttactagaccatctccatttttagcacttggcagcctcatgatccttttataaataggagattaacaggagagcagcaatacgattttgccaatggaataacagatttgccggcattcactgaaagagggcagatattgggtccttgtgacttcaactgactcttccgaattgtatgaatttatcaatgtattagataaacccagtttcagaataataaagaaaaaatattagaccaaataatgtggctaatagtggtatgatttctagcccgtgggtttaaaactgtatcctaaagagtcattttaaaataatataaatatttaaaagtgtaactgctatctttatgttctgaaataagttaaaacattttaaaatatgaatactgtagtttaaaagaaagaaatggtgggaaggaaaagtagagaaagaaatgccaattccagtccaaagctttgtttgccaagttttcttagaatgaattttaccaatgtatgggttcttgttaacagaatgtgtaacagaaatactgaaagacttttgcctaaagtggcattattgactgctggtgtgatgctactgtaatgtgataaattattaaattgttgcaaagtgct

SEQ ID NO: 308059 - DNA, 4105 bp, Homo sapiens
gcagaagggggagcctttctcaaactccatctctagaggtttatgttactgtcctctcaagagattcctgattcagactttgagttgtgaggctgtggctgaaaaccaacaaagacccaaatcctctgtccttgggagcttgggaacagttcctgttcccattgggtctgagaactttgcctttaaaatccattcctggcccctgcctgccgcttcctgtctggggaatagagttgagggggccaccctccatcactttaatttgactctccccacagaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacaggagaagaggcttcagcagctggccgagccacagagcgacttggaggagctgaagcacgagaacaagagcgcactgcagttggagcagcaagtaaaggagctgcaggagaagctgggccaggtgacggagacgctcacctcggctgagaaggagccagaggcagcagtcccagcctcagggactgggggcgagtctagcggccttatggacctcctggaggagaaggtggacctgagggagcatgtggagaaactggaacttggattcatccagtaccggagagagagatgccatcagaaagtacatcgccttctaacagagccaggggacagtgccaaagatgcgtcaccgggaggaggccatcatcaggctggcccaggacgaggaggagaggaaggtgaagctgttggagctgcaggagatggtgttgcggcttgtggcagctacagcgaggggcacggcaaattcctggccgctgcccggaaccctgctgctgaacccagtccaggagccccagccccccaggagctcggggctgccgacaagcatggtgatctttgtgaggcgagcctcaccaacagcgtggagcctgcacaaggagaagccagggagggttcttcccaggacaaccctactgcacagccagtcgtgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtgcctctcactgatgttcactctggcatcctttagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttttaatgttattgcagcatggatgttcattacagaattcagatcttccatagctcaatatgcggtttgccctcaagtgtgcactgtttattactttgtaatatgccactatgagtactgacacttagagctgtttaaaggccgagaactggaaacagcctttcctccattttctgtgtattggtgatgggagtgataaccttttgggggagctttctaaatctcgcagaagaggaaagtggcctgctctggcaggtatgtgcaggatacagtgtgtttcatctgttccggtgccaagaatgagcactgtactgtggcagttccctttggatttgtatgtgctctgggctcatgaagatattgcatcgtgagctgcagcagttgcactctttttcagtgacctaaaaatggcttatttccgaggaatgaaaggctgccatcgttggctgtggatgtggaaaacctttcctagcttagagcatttgtatctacaatacattttaaagtcagagttcgtgttccctgttttaatcacatgactacctgtcccagtacacgaaagggcgctggttggcattcttcttaatgtatttagtaaagatcataagacatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaaataataacaaacattattataaactaatatatgtgagagtacttagttgaaacaaaaaggaattttagtagacagtattatattatctttgaaaatcaaggagaagtttatgcaactgaaaatgtttacacactgtgctgcaatctactgtttgtgaatgtcaatgtattatcaggaaacatgtctatacgatcgcagagttgtatttcctcacaaacttctttacgaagagtgaaatatgtttttgtacctctcagtttcagtcagggacatattttgtgcaatatttctgtgattgtgcctatgcgtgatgaatgaatgcatttcaatcatacattgcctaaatcataacttgatgatgcttgggaaagaatcaacagttaaaacttcatgaagttctaatgtctgtgttccaaaacacatcacattattaggttgtagggagatatgtatgtgtgctccctggggtggggagttttctagttactagaccatctccatttttagcacttggcagcctcatgatccttttataaataggagattaacaggagagcagcaatacgattttgccaatggaataacagatttgccggcattcactgaaagagggcagatattgggtccttgtgacttcaactgactcttccgaattgtatgaatttatcaatgtattagataaacccagtttcagaataataaagaaaaaatattagaccaaataatgtggctaatagtggtatgatttctagcccgtgggtttaaaactgtatcctaaagagtcattttaaaataatataaatatttaaaagtgtaactgctatctttatgttctgaaataagttaaaacattttaaaatatgaatactgtagtttaaaagaaagaaatggtgggaaggaaaagtagagaaagaaatgccaattccagtccaaagctttgtttgccaagttttcttagaatgaattttaccaatgtatgggttcttgttaacagaatgtgtaacagaaatactgaaagacttttgcctaaagtggcattattgactgctggtgtgatgctactgtaatgtgataaattattaaattgttgcaaagtgct

SEQ ID NO: 308060 - DNA, 2321 bp, Homo sapiens
ttggaactactgacctcaggtgatccgcccactttggcctcccgaaagtgctgggattacagtcatgagccaccatgcccagcctatttatttctgattctttaagggtgactggacgtgttgatcagcgctcgctgggatttggctgacgtgccccagccccgcctccctccccaccccacaatggcagaagaaactggacagagtaaattagctgcagccaagaaaaagttcaaagaatattggcagagaaaccgccctggtgttccagcagcagcgaagaggaacacgaaagcaaatggcagtagccctgagacggccgcttctggtggttgccactcatctgaggctgtgagtcttgcctggacaggcttttggggacagggggcccaaggagcagtagagggcaatcgttaagattgtggatggactgttgggtactggtgaaggattctggatttggccgggcacagtggctcacgcctgtaatccccacacttcgggagaccgaggcaggtggatcacaaggtcaggagatcgagaccatccaggcaaacacggtgaaatactaaaaaatacaaaaaaaaaagccgggcgtggtggcgggcgcctgcagtcccagctgctccggagtctgagggaggagaatggcgtgaacctaggaggcggagcttgcagtgagccaagatcacgccactgcactccagcctggaaggcagagagagactccgtttcaaaaaagaaaagaattctgggtttgaatcctgcctctccgtctgctagggatatgatttagggcaagttgcttgagctctttgggcctctgttttcacgtctgtatgatagaggtggtattgtttgacttgtatttgtgaagtttcaatgagattgataattgtcgattttatgttaatccctagtacatggcctgctgtcaacacccaggacacccaggatatggtctttgctgtttgattttcctcatccccagtctcaaggggaagccaggacaatgagaacagccacttcccatcaggagtcactgcaaggcccccagggtgggatggtggggagataagaaccgtgagagaagttggcacaaaggagttatgggacaaagggtccaagataggcagaaaagaaaatgttgccagttgatggggaagaaaggaagtcggagggctcagacactgagggggacagaacatctccatgtgcagtctcatctcttatagtcagcaacaggtatccacggggagggccctacatcatctgctaccctgaaggatctggaggtaggaggctctgggcggaggtgcagtgaccccgcaggccagccctccaacctcctcccgcagcggggactgggtgcccctctgccagctgagacagcccacacacaacccagccctaatgatcgttctctctacctctcccccaagtcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggccttcgggatggtttggtgaactgctggtgaggggggaggggggctgaccgaggcac

SEQ ID NO: 308061 - DNA, 1712 bp, Homo sapiens
ttggaactactgacctcaggtgatccgcccactttggcctcccgaaagtgctgggattacagtcatgagccaccatgcccagcctatttatttctgattctttaagggtgactggacgtgttgatcagcgctcgctgggatttggctgacgtgccccagccccgcctccctccccaccccacaatggcagaagaaactggacagagtaaattagctgcagccaagaaaaagttcaaagaatattggcagagaaaccgccctggtgttccagcagcagcgaagaggaacacgaaagcaaatggcagtagccctgagacggccgcttctggtggttgccactcatctgaggctgtgagtcttgcctggacaggcttttggggacagggggcccaaggagcagtagagggcaatcgttaagattgtggatggactgttgggtactggtgaaggattctggatttggccgggcacagtggctcacgcctgtaatccccacacttcgggagaccgaggcaggtggatcacaaggtcaggagatcgagaccatccaggcaaacacggtgaaatactaaaaaatacaaaaaaaaaagccgggcgtggtggcgggcgcctgcagtcccagctgctccggagtctgagggaggagaatggcgtgaacctaggaggcggagcttgcagtgagccaagatcacgccactgcactccagcctggaaggcagagagagactccgtttcaaaaaagaaaagaattctgggtttgaatcctgcctctccgtctgctagggatatgatttagggcaagttgcttgagctctttgggcctctgttttcacgtctgtatgatagaggtggtattgtttgacttgtatttgtgaagtttcaatgagattgataattgtcgattttatgttaatccctagtacatggcctgctgtcaacacccaggacacccaggatatggtctttgctgtttgattttcctcatccccagtctcaaggggaagccaggacaatgagaacagccacttcccatcaggagtcactgcaaggcccccagggtgggatggtggggagataagaaccgtgagagaagttggcacaaaggagttatgggacaaagggtccaagataggcagaaaagaaaatgttgccagttgatggggaagaaaggaagtcggagggctcagacactgagggggacagaacatctccatgtgcagtctcatctcttatagtcagcaacaggtatccacggggagggccctacatcatctgctaccctgaaggatctggaggtaggaggctctgggcggaggtgcagtgaccccgcaggccagccctccaacctcctcccgcagcggggactgggtgcccctctgccagctgagacagcccacacacaacccagccctaatgatcgttctctctacctctcccccaagtcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaatccagagactgacatagagaacaagaaccggggtcctcagagtcaccgcggccgatcacc

SEQ ID NO: 308062 - DNA, 256 bp, Homo sapiens
tgcagttggagcagcaagtaaaggagctgcaggagaagctgggccaggtgacggagacgctcacctcggctgagaaggagccagaggcagcagtcccagcctcagggactgggggcgagtctgtgagtggggagaccctccgggccctgcaggaagtcatggagaagctggaggggagtgagtcctagcatgggccaagaagggcagggctggggcaggtcgctgctgagatgtgaccccattattttggctccag

SEQ ID NO: 308063 - DNA, 302 bp, Homo sapiens
tgctgtgccttctctgcctccccctggtaagagctctgtcttcctcttcctataggaaaagaaagcaaacaatgagaaacagaaagctgaaagggagctagaggtgagtggagggtgtgaagtttcctcctgtcctccggagaatgtttctttccttctatttcagcacttgcttggcttttctcccaaagggtcaaatccagagattgaacacagagaaaaagaaactaaatacggacctgtatcacatgaaacattctctcagatactttgaaggtgggaatctgggcaccctgtcatcc

SEQ ID NO: 308064 - DNA, 5074 bp, Homo sapiens
gggtggattaattttttttttttgacgttcttagaacagtgcctgacttaattctacttcatagggttgatgtaattttgagacttaaataagttgatactaaaataccacttagtgtcccgaacactgtttgacattttagtatcaaccaagtctcaaggttacttcaatcctgtgaactagagccaaggcacctccagtggcctttcagaagttccatttccactcccgcctcatctcctaattctatctccccgttctctttactcgagccctcctggccttgcccttccttaggcctgatacgcacctatctgaagacctttgcactgcactccagcctggaaggcagagagagactccgtttcaaaaaagaaaagaattctgggtttgaatcctgcctctccgtctgctagggatatgatttagggcaagttgcttgagctctttgggcctctgttttcacgtctgtatgatagaggtggtattgtttgacttgtatttgtgaagtttcaatgagattgataattgtcgattttatgttaatccctagtacatggcctgctgtcaacacccaggacacccaggatatggtctttgctgtttgattttcctcatccccagtctcaaggggaagccaggacaatgagaacagccacttcccatcaggagtcactgcaaggcccccagggtgggatggtggggagataagaaccgtgagagaagttggcacaaaggagttatgggacaaagggtccaagataggcagaaaagaaaatgttgccagttgatggggaagaaaggaagtcggagggctcagacactgagggggacagaacatctccatgtgcagtctcatctcttatagtcagcaacaggtatccacggggagggccctacatcatctgctaccctgaaggatctggaggtaggaggctctgggcggaggtgcagtgaccccgcaggccagccctccaacctcctcccgcagcggggactgggtgcccctctgccagctgagacagcccacacacaacccagccctaatgatcgttctctctacctctcccccaagtcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacaggagaagaggcttcagcagctggccgagccacagagcgacttggaggagctgaagcacgagaacaagagcgcactgcagttggagcagcaagtaaaggagctgcaggagaagctgggccaggtgacggagacgctcacctcggctgagaaggagccagaggcagcagtcccagcctcagggactgggggcgagtctagcggccttatggacctcctggaggagaaggtggacctgagggagcatgtggagaaactggaacttggattcatccagtaccggagagagagatgccatcagaaagtacatcgccttctaacagagccaggggacagtgccaaagatgcgtcaccgggaggaggccatcatcaggctggcccaggacgaggaggagaggaaggtgaagctgttggagctgcaggagatggtgttgcggcttgtggcagctacagcgaggggcacggcaaattcctggccgctgcccggaaccctgctgctgaacccagtccaggagccccagccccccaggagctcggggctgccgacaagcatggtgatctttgtgaggcgagcctcaccaacagcgtggagcctgcacaaggagaagccagggagggttcttcccaggacaaccctactgcacagccagtcgtgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtgcctctcactgatgttcactctggcatcctttagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttttaatgttattgcagcatggatgttcattacagaattcagataaaatttgctaatgttctgctatgatgtttgatctcatcttaatcacagtgagctcttccatagctcaatatgcggtttgccctcaagtgtgcactgtttattactttgtaatatgccactatgagtactgacacttagagctgtttaaaggccgagaactggaaacagcctttcctccattttctgtgtattggtgatgggagtgataaccttttgggggagctttctaaatctcgcagaagaggaaagtggcctgctctggcaggtatgtgcaggatacagtgtgtttcatctgttccggtgccaagaatgagcactgtactgtggcagttccctttggatttgtatgtgctctgggctcatgaagatattgcatcgtgagctgcagcagttgcactctttttcagtgacctaaaaatggcttatttccgaggaatgaaaggctgccatcgttggctgtggatgtggaaaacctttcctagcttagagcatttgtatctacaatacattttaaagtcagagttcgtgttccctgttttaatcacatgactacctgtcccagtacacgaaagggcgctggttggcattcttcttaatgtatttagtaaagatcataagacatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaaataataacaaacattattataaactaatatatgtgagagtacttagttgaaacaaaaaggaattttagtagacagtattatattatctttgaaaatcaaggagaagtttatgcaactgaaaatgtttacacactgtgctgcaatctactgtttgtgaatgtcaatgtattatcaggaaacatgtctatacgatcgcagagttgtatttcctcacaaacttctttacgaagagtgaaatatgtttttgtacctctcagtttcagtcagggacatattttgtgcaatatttctgtgattgtgcctatgcgtgatgaatgaatgcatttcaatcatacattgcctaaatcataacttgatgatgcttgggaaagaatcaacagttaaaacttcatgaagttctaatgtctgtgttccaaaacacatcacattattaggttgtagggagatatgtatgtgtgctccctggggtggggagttttctagttactagaccatctccatttttagcacttggcagcctcatgatccttttataaataggagattaacaggagagcagcaatacgattttgccaatggaataacagatttgccggcattcactgaaagagggcagatattgggtccttgtgacttcaactgactcttccgaattgtatgaatttatcaatgtattagataaacccagtttcagaataataaagaaaaaatattagaccaaataatgtggctaatagtggtatgatttctagcccgtgggtttaaaactgtatcctaaagagtcattttaaaataatataaatatttaaaagtgtaactgctatctttatgttctgaaataagttaaaacattttaaaatatgaatactgtagtttaaaagaaagaaatggtgggaaggaaaagtagagaaagaaatgccaattccagtccaaagctttgtttgccaagttttcttagaatgaattttaccaatgtatgggttcttgttaacagaatgtgtaacagaaatactgaaagacttttgcctaaagtggcattattgactgctggtgtgatgctactgtaatgtgataaattattaaattgttgcaaagtgct

SEQ ID NO: 308065 - DNA, 5386 bp, Homo sapiens
ttggaactactgacctcaggtgatccgcccactttggcctcccgaaagtgctgggattacagtcatgagccaccatgcccagcctatttatttctgattctttaagggtgactggacgtgttgatcagcgctcgctgggatttggctgacgtgccccagccccgcctccctccccaccccacaatggcagaagaaactggacagagtaaattagctgcagccaagaaaaagttcaaagaatattggcagagaaaccgccctggtgttccagcagcagcgaagaggaacacgaaagcaaatggcagtagccctgagacggccgcttctggtggttgccactcatctgaggctgtgagtcttgcctggacaggcttttggggacagggggcccaaggagcagtagagggcaatcgttaagattgtggatggactgttgggtactggtgaaggattctggatttggccgggcacagtggctcacgcctgtaatccccacacttcgggagaccgaggcaggtggatcacaaggtcaggagatcgagaccatccaggcaaacacggtgaaatactaaaaaatacaaaaaaaaaagccgggcgtggtggcgggcgcctgcagtcccagctgctccggagtctgagggaggagaatggcgtgaacctaggaggcggagcttgcagtgagccaagatcacgccactgcactccagcctggaaggcagagagagactccgtttcaaaaaagaaaagaattctgggtttgaatcctgcctctccgtctgctagggatatgatttagggcaagttgcttgagctctttgggcctctgttttcacgtctgtatgatagaggtggtattgtttgacttgtatttgtgaagtttcaatgagattgataattgtcgattttatgttaatccctagtacatggcctgctgtcaacacccaggacacccaggatatggtctttgctgtttgattttcctcatccccagtctcaaggggaagccaggacaatgagaacagccacttcccatcaggagtcactgcaaggcccccagggtgggatggtggggagataagaaccgtgagagaagttggcacaaaggagttatgggacaaagggtccaagataggcagaaaagaaaatgttgccagttgatggggaagaaaggaagtcggagggctcagacactgagggggacagaacatctccatgtgcagtctcatctcttatagtcagcaacaggtatccacggggagggccctacatcatctgctaccctgaaggatctggaggtaggaggctctgggcggaggtgcagtgaccccgcaggccagccctccaacctcctcccgcagcggggactgggtgcccctctgccagctgagacagcccacacacaacccagccctaatgatcgttctctctacctctcccccaagtcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacaggagaagaggcttcagcagctggccgagccacagagcgacttggaggagctgaagcacgagaacaagagcgcactgcagttggagcagcaagtaaaggagctgcaggagaagctgggccaggtgacggagacgctcacctcggctgagaaggagccagaggcagcagtcccagcctcagggactgggggcgagtctagcggccttatggacctcctggaggagaaggtggacctgagggagcatgtggagaaactggaacttggattcatccagtaccggagagagagatgccatcagaaagtacatcgccttctaacagagccaggggacagtgccaaagatgcgtcaccgggaggaggccatcatcaggctggcccaggacgaggaggagaggaaggtgaagctgttggagctgcaggagatggtgttgcggcttgtggcagctacagcgaggggcacggcaaattcctggccgctgcccggaaccctgctgctgaacccagtccaggagccccagccccccaggagctcggggctgccgacaagcatggtgatctttgtgaggcgagcctcaccaacagcgtggagcctgcacaaggagaagccagggagggttcttcccaggacaaccctactgcacagccagtcgtgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtgcctctcactgatgttcactctggcatcctttagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttttaatgttattgcagcatggatgttcattacagaattcagatcttccatagctcaatatgcggtttgccctcaagtgtgcactgtttattactttgtaatatgccactatgagtactgacacttagagctgtttaaaggccgagaactggaaacagcctttcctccattttctgtgtattggtgatgggagtgataaccttttgggggagctttctaaatctcgcagaagaggaaagtggcctgctctggcaggtatgtgcaggatacagtgtgtttcatctgttccggtgccaagaatgagcactgtactgtggcagttccctttggatttgtatgtgctctgggctcatgaagatattgcatcgtgagctgcagcagttgcactctttttcagtgacctaaaaatggcttatttccgaggaatgaaaggctgccatcgttggctgtggatgtggaaaacctttcctagcttagagcatttgtatctacaatacattttaaagtcagagttcgtgttccctgttttaatcacatgactacctgtcccagtacacgaaagggcgctggttggcattcttcttaatgtatttagtaaagatcataagacatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaaataataacaaacattattataaactaatatatgtgagagtacttagttgaaacaaaaaggaattttagtagacagtattatattatctttgaaaatcaaggagaagtttatgcaactgaaaatgtttacacactgtgctgcaatctactgtttgtgaatgtcaatgtattatcaggaaacatgtctatacgatcgcagagttgtatttcctcacaaacttctttacgaagagtgaaatatgtttttgtacctctcagtttcagtcagggacatattttgtgcaatatttctgtgattgtgcctatgcgtgatgaatgaatgcatttcaatcatacattgcctaaatcataacttgatgatgcttgggaaagaatcaacagttaaaacttcatgaagttctaatgtctgtgttccaaaacacatcacattattaggttgtagggagatatgtatgtgtgctccctggggtggggagttttctagttactagaccatctccatttttagcacttggcagcctcatgatccttttataaataggagattaacaggagagcagcaatacgattttgccaatggaataacagatttgccggcattcactgaaagagggcagatattgggtccttgtgacttcaactgactcttccgaattgtatgaatttatcaatgtattagataaacccagtttcagaataataaagaaaaaatattagaccaaataatgtggctaatagtggtatgatttctagcccgtgggtttaaaactgtatcctaaagagtcattttaaaataatataaatatttaaaagtgtaactgctatctttatgttctgaaataagttaaaacattttaaaatatgaatactgtagtttaaaagaaagaaatggtgggaaggaaaagtagagaaagaaatgccaattccagtccaaagctttgtttgccaagttttcttagaatgaattttaccaatgtatgggttcttgttaacagaatgtgtaacagaaatactgaaagacttttgcctaaagtggcattattgactgctggtgtgatgctactgtaatgtgataaattattaaattgttgcaaagtgct

SEQ ID NO: 308066 - DNA, 5148 bp, Homo sapiens
ttggaactactgacctcaggtgatccgcccactttggcctcccgaaagtgctgggattacagtcatgagccaccatgcccagcctatttatttctgattctttaagggtgactggacgtgttgatcagcgctcgctgggatttggctgacgtgccccagccccgcctccctccccaccccacaatggcagaagaaactggacagagtaaattagctgcagccaagaaaaagttcaaagaatattggcagagaaaccgccctggtgttccagcagcagcgaagaggaacacgaaagcaaatggcagtagccctgagacggccgcttctggtggttgccactcatctgaggctgtgagtcttgcctggacaggcttttggggacagggggcccaaggagcagtagagggcaatcgttaagattgtggatggactgttgggtactggtgaaggattctggatttggccgggcacagtggctcacgcctgtaatccccacacttcgggagaccgaggcaggtggatcacaaggtcaggagatcgagaccatccaggcaaacacggtgaaatactaaaaaatacaaaaaaaaaagccgggcgtggtggcgggcgcctgcagtcccagctgctccggagtctgagggaggagaatggcgtgaacctaggaggcggagcttgcagtgagccaagatcacgccactgcactccagcctggaaggcagagagagactccgtttcaaaaaagaaaagaattctgggtttgaatcctgcctctccgtctgctagggatatgatttagggcaagttgcttgagctctttgggcctctgttttcacgtctgtatgatagaggtggtattgtttgacttgtatttgtgaagtttcaatgagattgataattgtcgattttatgttaatccctagtacatggcctgctgtcaacacccaggacacccaggatatggtctttgctgtttgattttcctcatccccagtctcaaggggaagccaggacaatgagaacagccacttcccatcaggagtcactgcaaggcccccagggtgggatggtggggagataagaaccgtgagagaagttggcacaaaggagttatgggacaaagggtccaagataggcagaaaagaaaatgttgccagttgatggggaagaaaggaagtcggagggctcagacactgagggggacagaacatctccatgtgcagtctcatctcttatagtcagcaacaggtatccacggggagggccctacatcatctgctaccctgaaggatctggaggtaggaggctctgggcggaggtgcagtgaccccgcaggccagccctccaacctcctcccgcagcggggactgggtgcccctctgccagctgagacagcccacacacaacccagccctaatgatcgttctctctacctctcccccaagtcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccactggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacaggagaagaggcttcagcagctggccgagccacagagcgacttggaggagctgaagcacgagaacaagagcgcactgcagttggagcagcaagtaaaggagctgcaggagaagctgggccaggtgacggagacgctcacctcggctgagaaggagccagaggcagcagtcccagcctcagggactgggggcgagtctagcggccttatggacctcctggaggagaaggtggacctgagggagcatgtggagaaactggaacttggattcatccagtaccggagagagagatgccatcagaaagtacatcgccttctaacagagccaggggacagtgccaaagatgcgtcaccgggaggaggccatcatcaggctggcccaggacgaggaggagaggaaggtgaagctgttggagctgcaggagatggtgttgcggcttgtggcagctacagcgaggggcacggcaaattcctggccgctgcccggaaccctgctgctgaacccagtccaggagccccagccccccaggagctcggggctgccgacaagcatggtgatctttgtgaggcgagcctcaccaacagcgtggagcctgcacaaggagaagccagggagggttcttcccaggacaaccctactgcacagccagtcgtgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtgcctctcactgatgttcactctggcatcctttagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttttaatgttattgcagcatggatgttcattacagaattcagatcttccatagctcaatatgcggtttgccctcaagtgtgcactgtttattactttgtaatatgccactatgagtactgacacttagagctgtttaaaggccgagaactggaaacagcctttcctccattttctgtgtattggtgatgggagtgataaccttttgggggagctttctaaatctcgcagaagaggaaagtggcctgctctggcaggtatgtgcaggatacagtgtgtttcatctgttccggtgccaagaatgagcactgtactgtggcagttccctttggatttgtatgtgctctgggctcatgaagatattgcatcgtgagctgcagcagttgcactctttttcagtgacctaaaaatggcttatttccgaggaatgaaaggctgccatcgttggctgtggatgtggaaaacctttcctagcttagagcatttgtatctacaatacattttaaagtcagagttcgtgttccctgttttaatcacatgactacctgtcccagtacacgaaagggcgctggttggcattcttcttaatgtatttagtaaagatcataagacatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaaataataacaaacattattataaactaatatatgtgagagtacttagttgaaacaaaaaggaattttagtagacagtattatattatctttgaaaatcaaggagaagtttatgcaactgaaaatgtttacacactgtgctgcaatctactgtttgtgaatgtcaatgtattatcaggaaacatgtctatacgatcgcagagttgtatttcctcacaaacttctttacgaagagtgaaatatgtttttgtacctctcagtttcagtcagggacatattttgtgcaatatttctgtgattgtgcctatgcgtgatgaatgaatgcatttcaatcatacattgcctaaatcataacttgatgatgcttgggaaagaatcaacagttaaaacttcatgaagttctaatgtctgtgttccaaaacacatcacattattaggttgtagggagatatgtatgtgtgctccctggggtggggagttttctagttactagaccatctccatttttagcacttggcagcctcatgatccttttataaataggagattaacaggagagcagcaatacgattttgccaatggaataacagatttgccggcattcactgaaagagggcagatattgggtccttgtgacttcaactgactcttccgaattgtatgaatttatcaatgtattagataaacccagtttcagaataataaagaaaaaatattagaccaaataatgtggctaatagtggtatgatttctagcccgtgggtttaaaactgtatcctaaagagtcattttaaaataatataaatatttaaaagtgtaactgctatctttatgttctgaaataagttaaaacattttaaaatatgaatactgtagtttaaaagaaagaaatggtgggaaggaaaagtagagaaagaaatgccaattccagtccaaagctttgtttgccaagttttcttagaatgaattttaccaatgtatgggttcttgttaacagaatgtgtaacagaaatactgaaagacttttgcctaaagtggcattattgactgctggtgtgatgctactgtaatgtgataaattattaaattgttgcaaagtgct

SEQ ID NO: 308067 - DNA, 2747 bp, Homo sapiens
ttggaactactgacctcaggtgatccgcccactttggcctcccgaaagtgctgggattacagtcatgagccaccatgcccagcctatttatttctgattctttaagggtgactggacgtgttgatcagcgctcgctgggatttggctgacgtgccccagccccgcctccctccccaccccacaatggcagaagaaactggacagagtaaattagctgcagccaagaaaaagttcaaagaatattggcagagaaaccgccctggtgttccagcagcagcgaagaggaacacgaaagcaaatggcagtagccctgagacggccgcttctggtggttgccactcatctgaggctgtgagtcttgcctggacaggcttttggggacagggggcccaaggagcagtagagggcaatcgttaagattgtggatggactgttgggtactggtgaaggattctggatttggccgggcacagtggctcacgcctgtaatccccacacttcgggagaccgaggcaggtggatcacaaggtcaggagatcgagaccatccaggcaaacacggtgaaatactaaaaaatacaaaaaaaaaagccgggcgtggtggcgggcgcctgcagtcccagctgctccggagtctgagggaggagaatggcgtgaacctaggaggcggagcttgcagtgagccaagatcacgccactgcactccagcctggaaggcagagagagactccgtttcaaaaaagaaaagaattctgggtttgaatcctgcctctccgtctgctagggatatgatttagggcaagttgcttgagctctttgggcctctgttttcacgtctgtatgatagaggtggtattgtttgacttgtatttgtgaagtttcaatgagattgataattgtcgattttatgttaatccctagtacatggcctgctgtcaacacccaggacacccaggatatggtctttgctgtttgattttcctcatccccagtctcaaggggaagccaggacaatgagaacagccacttcccatcaggagtcactgcaaggcccccagggtgggatggtggggagataagaaccgtgagagaagttggcacaaaggagttatgggacaaagggtccaagataggcagaaaagaaaatgttgccagttgatggggaagaaaggaagtcggagggctcagacactgagggggacagaacatctccatgtgcagtctcatctcttatagtcagcaacaggtatccacggggagggccctacatcatctgctaccctgaaggatctggaggtaggaggctctgggcggaggtgcagtgaccccgcaggccagccctccaacctcctcccgcagcggggactgggtgcccctctgccagctgagacagcccacacacaacccagccctaatgatcgttctctctacctctcccccaagtcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacaggagaagaggcttcagcagctggccgagccacagagcgacttggaggagctgaagcacgagaacaagagcgcactgcagttggagcagcaagtaaaggagctgcaggagaagctgggccaggtgacggagacgctcacctcggctgagaaggagccagaggcagcagtcccagcctcagggactgggggcgagtctagcggccttatggacctcctggaggagaaggtggacctgagggagcatgtggagaaactggaacttggattcatccagtaccggagagagagatgccatcagaaagtacatcgccttctaacagagccaggggacagtgccaaagatgcgtcaccgggaggaggccatcatcaggctggcccaggacgaggaggagaggaaggtagggtgtgcaacatccct

SEQ ID NO: 308068 - DNA, 2250 bp, Homo sapiens
ttggaactactgacctcaggtgatccgcccactttggcctcccgaaagtgctgggattacagtcatgagccaccatgcccagcctatttatttctgattctttaagggtgactggacgtgttgatcagcgctcgctgggatttggctgacgtgccccagccccgcctccctccccaccccacaatggcagaagaaactggacagagtaaattagctgcagccaagaaaaagttcaaagaatattggcagagaaaccgccctggtgttccagcagcagcgaagaggaacacgaaagcaaatggcagtagccctgagacggccgcttctggtggttgccactcatctgaggctgtgagtcttgcctggacaggcttttggggacagggggcccaaggagcagtagagggcaatcgttaagattgtggatggactgttgggtactggtgaaggattctggatttggccgggcacagtggctcacgcctgtaatccccacacttcgggagaccgaggcaggtggatcacaaggtcaggagatcgagaccatccaggcaaacacggtgaaatactaaaaaatacaaaaaaaaaagccgggcgtggtggcgggcgcctgcagtcccagctgctccggagtctgagggaggagaatggcgtgaacctaggaggcggagcttgcagtgagccaagatcacgccactgcactccagcctggaaggcagagagagactccgtttcaaaaaagaaaagaattctgggtttgaatcctgcctctccgtctgctagggatatgatttagggcaagttgcttgagctctttgggcctctgttttcacgtctgtatgatagaggtggtattgtttgacttgtatttgtgaagtttcaatgagattgataattgtcgattttatgttaatccctagtacatggcctgctgtcaacacccaggacacccaggatatggtctttgctgtttgattttcctcatccccagtctcaaggggaagccaggacaatgagaacagccacttcccatcaggagtcactgcaaggcccccagggtgggatggtggggagataagaaccgtgagagaagttggcacaaaggagttatgggacaaagggtccaagataggcagaaaagaaaatgttgccagttgatggggaagaaaggaagtcggagggctcagacactgagggggacagaacatctccatgtgcagtctcatctcttatagtcagcaacaggtatccacggggagggccctacatcatctgctaccctgaaggatctggaggtaggaggctctgggcggaggtgcagtgaccccgcaggccagccctccaacctcctcccgcagcggggactgggtgcccctctgccagctgagacagcccacacacaacccagccctaatgatcgttctctctacctctcccccaagtcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaagaggtgctgaagaagaactgcccgcatatcgtcgtggggactccaggccgtatcctagccgtggctcgaaataagagcctcaacctcaaacacattaaacactttattttggatgaatgtgataagatgcttgaacagctcgacatgcgtcgggatgtccagaatttttcgcatgaccccccacgagaagctggccgaga

SEQ ID NO: 308069 - DNA, 867 bp, Homo sapiens
cattctgcttctttgcctctggttacgcaggctgttttcaaaagaaaacaagagaagttgtaagactgactttcccaagaactatacactcatttataccaggaaacagacaagagaacaagaggctgccgaagacaaaacttctctgcaagcacctgtgcacagcaatgtgcgtgggcatctgtgagaagaagagaatctgtgaagtttgagcaagcggccttcccaagatgtaccgaatatctcaactgatgtcaacaccagtagcaagttcttccaggttggaaagagaatatgctggagagctgtctcccacgtgcattttcccaagtttcacctgtgattccctggatggttaccattcttttgaatgcggctccatagatcccctgacaggctcccactatacctgtcgccgaagtcccagactcctcaccaatggctactatatttggactgaagacagcttcctgtgcgacaaagatggcaacataactctgaacccatcccagaccagcgttatgtataaggagaacttagttaggatatttagaaagaaaaagagaatctgccattccttttcttctctcttcaacctcagtacctccaaatcttggctgcatggaagtatctttggtgacatcaactcttctccaagtgaagacaactggttgaaggggaccaggaggttggacacagaccattgcaatggaaatgaaaccaggttgttgcaagaggtcttctttcaggcaatcctgcttgctgtgtgcttaatcatttctgcatgtgcaagatggttaatggggagacattttaggccagtggtcttaaaatgctcattggatgataactggtagctaatgtgaa

SEQ ID NO: 308070 - DNA, 532 bp, Homo sapiens
cattctgcttctttgcctctggttacgcaggctgttttcaaaagaaaacaagagaagttgtaagactgactttcccaagaactatacactcatttataccaggaaacagacaagagaacaagaggctgccgaagacaaaacttctctgcaagcacctgtgcacagcaatgtgcgtgggcatctgtgagaagaagagaatctgtgaagtttgagcaagcggccttcccaagatgtaccgaatatctcaactgatgtcaacaccagtagcaagtaaatgtagaagaactgtgatacgcaattatcttttgaacgattagactccttttagcaatttccttgctttgattttgctgatactcagaccattaaccatctgtcagtagcttgtgcttcttaaatgccagtgttcactttggcaatgattttaacttcatttttttccttgaaagaaatgtggtatttttccttctagtagaaaaaaaaaatcaccgtttttttttagatgcctgtgcataaatgtgaaaggagattg

SEQ ID NO: 308071 - DNA, 2142 bp, Homo sapiens
cattctgcttctttgcctctggttacgcaggctgttttcaaaagaaaacaagagaagttgtaagactgactttcccaagaactatacactcatttataccaggaaacagacaagagaacaagaggctgccgaagacaaaacttctctgcaagcacctgtgcacagcaatgtgcgtgggcatctgtgagaagaagagaatctgtgaagtttgagcaagcggccttcccaagatgtaccgaatatctcaactgatgtcaacaccagtagcaagttcttccaggttggaaagagaatatgctggagagctgtctcccacgtgcattttcccaagtttcacctgtgattccctggatggttaccattcttttgaatgcggctccatagatcccctgacaggctcccactatacctgtcgccgaagtcccagactcctcaccaatggctactatatttggactgaagacagcttcctgtgcgacaaagatggcaacataactctgaacccatcccagaccagcgttatgtataaggagaacttagttaggatatttagaaagaaaaagagaatctgccattccttttcttctctcttcaacctcagtacctccaaatcttggctgcatggaagtatctttggtgacatcaactcttctccaagtgaagacaactggttgaaggggaccaggaggttggacacagaccattgcaatggaaatgcagatgatttagactgttcttctctgactgatgactgggagtcagggaagatgaatgcagagtctgtgatcacctcctcttccagccacatcatatctcagcctcctggaggaaactcccatagcttgtctcttcagtcccagttgacagcttctgaacgtttccaagagaatagttcggatcattcagaaaccaggttgttgcaagaggtcttctttcaggcaatcctgcttgctgtgtgcttaatcatttctgcatgtgcaagatggtttatgggagaaatattagccagtgtcttcacatgctcattgatgataactgtagcttatgtgaaatcattgtttctcagccttgccagctatttcaaaaccactgcctgtgctcggttgtcaaaatttgacaaccatttaggaatgccttcgatgaatgtcctccatctgaatatctggaaattgtccaacttgcagtctacttggaatcaagtgttttattggaagggagtaagcgagtaatggagaaaaagccattttagtttgactatgtgattttaaaatgatctcagtttttccatcaaaattataatatgctcatgaaaataatattaatttgccttccctttgcaaacaccggcagttgaaaggaaaaggacggggaatgtgatggaaaagagaccgcctggaataaatgtccccctatgattctttaaggcagtggttctcgagcttgaattttcattaggaaattctgtgaggagcttgtaaccagatttctgggtctgccacatgcacctatctcttgctgaattgctttaatagaataatgagagcaagtttgtctaactaataccaacctgacaacttgaataacaataaatgcaatttgtacataaaatataatgctgcaaaagtttgtcattcacctcagtggagtgacttgatattaggtggtaaccgtagatgatggttaatatgaaaatggacaggaaagaagcattttctgaaagttatattcttttgaaccacgttctaaaccaagtttttaatcttcttggggctcgtaattacctttcactttaatgtcacttaaagatataacacagaaaaatgccttgagggcaaaatataggcaaaacaccaatgcgctttcaaatgcatgaaaatggtgcagttgtacccttgagccttgactcaagggctgtagatgttccctttccaccccccacacttggtgcgtgttcacaaagcaaatatggcctgtaattcaaatttgttctatgtgatactctctgagtaaaaactcatacatgcagaaaattgtctttgctcgaaatggtaatgccaaaatataactttatatataatttgcatttagtacatttttggttaaaaaataaactaataaataagtgaagtcatcagcaaaata

SEQ ID NO: 308072 - DNA, 2085 bp, Homo sapiens
cattctgcttctttgcctctggttacgcaggctgttttcaaaagaaaacaagagaagttgtaagactgactttcccaagaactatacactcatttataccaggaaacagacaagagaacaagaggctgccgaagacaaaacttctctgcaagcacctgtgcacagcaatgtgcgtgggcatctgtgagaagaagagaatctgtgaagtttgagcaagcggccttcccaagatgtaccgaatatctcaactgatgtcaacaccagtagcaagttcttccaggttggaaagagaatatgctggagagctgtctcccacgtgcattttcccaagtttcacctgtgattccctggatggttaccattcttttgaatgcggctccatagatcccctgacaggctcccactatacctgtcgccgaagtcccagactcctcaccaatggctactatatttggactgaagacagcttcctgtgcgacaaagatggcaacataactctgaacccatcccagaccagcgttatgtataaggagaacttagttagtacctccaaatcttggctgcatggaagtatctttggtgacatcaactcttctccaagtgaagacaactggttgaaggggaccaggaggttggacacagaccattgcaatggaaatgcagatgatttagactgttcttctctgactgatgactgggagtcagggaagatgaatgcagagtctgtgatcacctcctcttccagccacatcatatctcagcctcctggaggaaactcccatagcttgtctcttcagtcccagttgacagcttctgaacgtttccaagagaatagttcggatcattcagaaaccaggttgttgcaagaggtcttctttcaggcaatcctgcttgctgtgtgcttaatcatttctgcatgtgcaagatggtttatgggagaaatattagccagtgtcttcacatgctcattgatgataactgtagcttatgtgaaatcattgtttctcagccttgccagctatttcaaaaccactgcctgtgctcggttgtcaaaatttgacaaccatttaggaatgccttcgatgaatgtcctccatctgaatatctggaaattgtccaacttgcagtctacttggaatcaagtgttttattggaagggagtaagcgagtaatggagaaaaagccattttagtttgactatgtgattttaaaatgatctcagtttttccatcaaaattataatatgctcatgaaaataatattaatttgccttccctttgcaaacaccggcagttgaaaggaaaaggacggggaatgtgatggaaaagagaccgcctggaataaatgtccccctatgattctttaaggcagtggttctcgagcttgaattttcattaggaaattctgtgaggagcttgtaaccagatttctgggtctgccacatgcacctatctcttgctgaattgctttaatagaataatgagagcaagtttgtctaactaataccaacctgacaacttgaataacaataaatgcaatttgtacataaaatataatgctgcaaaagtttgtcattcacctcagtggagtgacttgatattaggtggtaaccgtagatgatggttaatatgaaaatggacaggaaagaagcattttctgaaagttatattcttttgaaccacgttctaaaccaagtttttaatcttcttggggctcgtaattacctttcactttaatgtcacttaaagatataacacagaaaaatgccttgagggcaaaatataggcaaaacaccaatgcgctttcaaatgcatgaaaatggtgcagttgtacccttgagccttgactcaagggctgtagatgttccctttccaccccccacacttggtgcgtgttcacaaagcaaatatggcctgtaattcaaatttgttctatgtgatactctctgagtaaaaactcatacatgcagaaaattgtctttgctcgaaatggtaatgccaaaatataactttatatataatttgcatttagtacatttttggttaaaaaataaactaataaataagtgaagtcatcagcaaaata

SEQ ID NO: 308073 - DNA, 2029 bp, Homo sapiens
ttgctctgcatcctcccagcattttgtattgccagttgtttgggttttagccattctactaggtatgcagtgatatctcgctgttttaatttgcattactgtaatgaggaatgatgttgaacatctgtttttatacttattgacatttgtatatattctttggtgaagtgtctgttcagatcttttgctcattttttcaagtgggttgcttattttcttattattgaattttgagagttctttatatattatggatagaagtccttgattagatacataatttgcaaatattttctcacagactgcgccttgtcttttcattctcttagcagtgtctttcacagtgcagaagttttacattttgataaagtccaattattcctttctcttctttcatggattgtgcatttggtattgcattttaaaactcattgccaaatgcaaggtcatattgatattcccccatgttttcttctagaagttttacagttttacgatctacatttttggtctatgacccattttgagttaaattttgtgtaaggtatgttatacatgtggaggttcatttttttgcatgtaaatatccaattgtttcaacaccattggttgaaaagacggtatgttctcctttgaatgcttctgcgcctcaattaaaatcagtttactctatctgcataagtctacttctgggctgtctactctctttcattgatctgtatgtctgtccattttccaataccactgtctttattactgtagtttcatagtaaaccttgaaatcataattctatagtaagtctaaaaaaatcacacaggttggaaatgcacaattagtatgctaaatcagagcaatcttgttgtttcagatggtttatgggagaaatattagccagtgtcttcacatgctcattgatgataactgtagcttatgtgaaatcattgtttctcagccttgccagctatttcaaaaccactgcctgtgctcggttgtcaaaatttgacaaccatttaggaatgccttcgatgaatgtcctccatctgaatatctggaaattgtccaacttgcagtctacttggaatcaagtgttttattggaagggagtaagcgagtaatggagaaaaagccattttagtttgactatgtgattttaaaatgatctcagtttttccatcaaaattataatatgctcatgaaaataatattaatttgccttccctttgcaaacaccggcagttgaaaggaaaaggacggggaatgtgatggaaaagagaccgcctggaataaatgtccccctatgattctttaaggcagtggttctcgagcttgaattttcattaggaaattctgtgaggagcttgtaaccagatttctgggtctgccacatgcacctatctcttgctgaattgctttaatagaataatgagagcaagtttgtctaactaataccaacctgacaacttgaataacaataaatgcaatttgtacataaaatataatgctgcaaaagtttgtcattcacctcagtggagtgacttgatattaggtggtaaccgtagatgatggttaatatgaaaatggacaggaaagaagcattttctgaaagttatattcttttgaaccacgttctaaaccaagtttttaatcttcttggggctcgtaattacctttcactttaatgtcacttaaagatataacacagaaaaatgccttgagggcaaaatataggcaaaacaccaatgcgctttcaaatgcatgaaaatggtgcagttgtacccttgagccttgactcaagggctgtagatgttccctttccaccccccacacttggtgcgtgttcacaaagcaaatatggcctgtaattcaaatttgttctatgtgatactctctgagtaaaaactcatacatgcagaaaattgtctttgctcgaaatggtaatgccaaaatataactttatatataatttgcatttagtacatttttggttaaaaaataaactaataaataagtgaagtcatcagcaaaata

SEQ ID NO: 308074 - DNA, 2799 bp, Homo sapiens
  misc_feature (1)..(3): n is a, c, g, or t
  misc_feature (6)..(6): n is a, c, g, or t
  misc_feature (8)..(8): n is a, c, g, or t
nnnacnangggcacattggcggccagggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagagagacgcggagaactcctaaggaggagattggacaggctggactccccattgcttttctaaaaatcttggaaactttgtccttcattgaattacgacactgtccacctttaatttcctcgaaaacgcctgtaactcggctgaagccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataaggtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtt

SEQ ID NO: 308075 - DNA, 2621 bp, Homo sapiens
  misc_feature (1)..(3): n is a, c, g, or t
  misc_feature (6)..(6): n is a, c, g, or t
  misc_feature (8)..(8): n is a, c, g, or t
nnnacnangggcacattggcggccagggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagagagacgcggagaactcctaaggaggagattggacaggctggactccccattgcttttctaaaaatcttggaaactttgtccttcattgaattacgacactgtccacctttaatttcctcgaaaacgcctgtaactcggctgaagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataaggtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtt

SEQ ID NO: 308076 - DNA, 578 bp, Homo sapiens
cctctctctctttggtattaattgcaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaatgtatatcgcatacaagtggatacatcaagaacagctatgcagtagtacagtc

SEQ ID NO: 308077 - DNA, 844 bp, Homo sapiens
tgaatactaacatgtcaattgttttgtggagataagagtgaacgtttcccagggctggatggcactgtatttagtctgtatggaaatggcaatttacatatttaaagcagcgacctcgtagcaccatccctaattgaattaattgccccggaacatctaatttccttactggtcagagagaggtttaattgttataaaaacctggctcccctattagaaacggggttagcaatttcacgggttatatattttagagaacctcattaagtgctttttaaaatgaaattccagttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtaataagggagggaggagacaatccagggaggctgtgagagaaatcaagaaaggaaaagaaagggaggaagggaaaccagagggtggggtagagaaaaagacagaataggaaatggaagtcggagaaaggaagaaaaagaaagaaaacaaaaaaagacgagaagaagcgagcccagaagccttggatgaatggaatggaggtgggatagggggcgttcttgattgttatgaaattaaaccctttcaaggtccactggtctacattttattaactcttcagtaattaggtgactcttaaatccctcatttattgctcttcaagtaattagttgtttagcttttctctctc

SEQ ID NO: 308078 - DNA, 3522 bp, Homo sapiens
  misc_feature (1)..(3): n is a, c, g, or t
  misc_feature (6)..(6): n is a, c, g, or t
  misc_feature (8)..(8): n is a, c, g, or t
nnnacnangggcacattggcggccagggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagagagacgcggagaactcctaaggaggagattggacaggctggactccccattgcttttctaaaaatcttggaaactttgtccttcattgaattacgacactgtccacctttaatttcctcgaaaacgcctgtaactcggctgaagccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataaggtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgcaaaaaaaaagaaaataaatacataaaaaagggacaagcatgttgattctaggttgaaaatgttataggcacttgctacttcagtaatgtctatattatataaatagtatttcagacactatgtagtctgttagattttataaagattggtagttatctgagcttaaacattttctcaattgtaaaataggtgggcacaagtattacacatcagaaaatcctgacaaaagggacacatagtgtttgtaacaccgtccaacattccttgtttgtaagtgttgtatgtaccgttgatgttgataaaaagaaagtttatatcttgattattttgttgtctaaagctaaacaaaacttgcatgcagcagcttttgactgtttccagagtgcttataatatacataactccctggaaataactgagcactttgaattttttttatgtctaaaattgtcagttaatttattattttgtttgagtaagaattttaatattgccatattctgtagtatttttctttgtatatttctagtatggcacatgatatgagtcactgcctttttttctatggtgtatgacagttagagatgctgattttttttctgataaattctttctttgagaaagacaattttaatgtttacaacaataaacctgtgtacgcgacaaacttatttgtgctttgtcattatctaacaatattcgtgaaacaccgtctgatat

SEQ ID NO: 308079 - DNA, 4001 bp, Homo sapiens
  misc_feature (1)..(3): n is a, c, g, or t
  misc_feature (6)..(6): n is a, c, g, or t
  misc_feature (8)..(8): n is a, c, g, or t
nnnacnangggcacattggcggccagggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagagagacgcggagaactcctaaggaggagattggacaggctggactccccattgcttttctaaaaatcttggaaactttgtccttcattgaattacgacactgtccacctttaatttcctcgaaaacgcctgtaactcggctgaaggttagtgcaacttcatttctttcctttactctccagagctccccaaacatcaagaaacaggacaaggcaaaccctgtaacttaaggtttgcccgacccatcgccttcgggaacaactttctcattgtgaaattcaacttcatttctagatggtcatttctagaaagagactgctgaatctgagcttcagagaagaggctcatctgagtgggatgagtgggggggtatgagggagatgtttggaaatacccaggagtgtagaccctcagtagctttttagctctgggtctttatttggttagtctttccacgccctaaactgttgttctgcagcattctctctctcctgcctttcctctcgcgcccctacatgctctctgactgccgcgggctgccggtgtagctccaggtgtacccgagcccgggagaaagtgttcagttgaccaggctgagtgtgttatcaccctgtttcatttccagccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataaggtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgcaaaaaaaaagaaaataaatacataaaaaagggacaagcatgttgattctaggttgaaaatgttataggcacttgctacttcagtaatgtctatattatataaatagtatttcagacactatgtagtctgttagattttataaagattggtagttatctgagcttaaacattttctcaattgtaaaataggtgggcacaagtattacacatcagaaaatcctgacaaaagggacacatagtgtttgtaacaccgtccaacattccttgtttgtaagtgttgtatgtaccgttgatgttgataaaaagaaagtttatatcttgattattttgttgtctaaagctaaacaaaacttgcatgcagcagcttttgactgtttccagagtgcttataatatacataactccctggaaataactgagcactttgaattttttttatgtctaaaattgtcagttaatttattattttgtttgagtaagaattttaatattgccatattctgtagtatttttctttgtatatttctagtatggcacatgatatgagtcactgcctttttttctatggtgtatgacagttagagatgctgattttttttctgataaattctttctttgagaaagacaattttaatgtttacaacaataaacctgtgtacgcgacaaacttatttgtgctttgtcattatctaacaatattcgtgaaacaccgtctgatat

SEQ ID NO: 308080 - DNA, 3410 bp, Homo sapiens
  misc_feature (1)..(3): n is a, c, g, or t
  misc_feature (6)..(6): n is a, c, g, or t
  misc_feature (8)..(8): n is a, c, g, or t
nnnacnangggcacattggcggccagggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagagagacgcggagaactcctaaggaggagattggacaggctggactccccattgcttttctaaaaatcttggaaactttgtccttcattgaattacgacactgtccacctttaatttcctcgaaaacgcctgtaactcggctgaaggttagtgcaacttcatttctttcctttactctccagagctccccaaacatcaagaaacaggacaaggcaaaccctgtaacttaaggtttgcccgacccatcgccttcgggaacaactttctcattgtgaaattcaacttcatttctagatggtcatttctagaaagagactgctgaatctgagcttcagagaagaggctcatctgagtgggatgagtgggggggtatgagggagatgtttggaaatacccaggagtgtagaccctcagtagctttttagctctgggtctttatttggttagtctttccacgccctaaactgttgttctgcagcattctctctctcctgcctttcctctcgcgcccctacatgctctctgactgccgcgggctgccggtgtagctccaggtgtacccgagcccgggagaaagtgttcagttgaccaggctgagtgtgttatcaccctgtttcatttccagccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataaggtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgcaaaaaaaaagaaaataaatacataaaaaagggacaagcatgttgattctaggttgaaaatgttataggcacttgctacttcagtaatgtctatattatataaatagtatttcagacactatgtagtctgttagattttataaagattggtagttatctgagcttaaacattttctcaattgtaaaataggtgggcacaagtattacacatcagaaaatcctgacaaaagggacacatagtgtttgtaacaccgtccaacattccttgtttgtaagtgttgtatgtaccgttgatgttgataaaaagaaagtttatatcttgattattttgttgtctaaagctaaacaaaacttgcatgcagcagcttttgactgtttccagagtgcttataatatacataactccctggaaataactgagcactttgaattttttttatgtctaaaattgtcagttaatttattattttgtttgagtaagaattttaatattgccatattctgtagtatttttctttgtatatttctagtatggcacatgatatgagtcactgcctttttttctatggtgtatgacagttagagatgctgattttttttctgataaattctttctttgagaaagacaattttaatgtttacaacaataaacctgtgtacgcgacaaacttatttgtgctttgtcattatctaacaatattcgtgaaacaccgtctgatat

SEQ ID NO: 308081 - DNA, 3344 bp, Homo sapiens
  misc_feature (1)..(3): n is a, c, g, or t
  misc_feature (6)..(6): n is a, c, g, or t
  misc_feature (8)..(8): n is a, c, g, or t
nnnacnangggcacattggcggccagggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagagagacgcggagaactcctaaggaggagattggacaggctggactccccattgcttttctaaaaatcttggaaactttgtccttcattgaattacgacactgtccacctttaatttcctcgaaaacgcctgtaactcggctgaagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataaggtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgcaaaaaaaaagaaaataaatacataaaaaagggacaagcatgttgattctaggttgaaaatgttataggcacttgctacttcagtaatgtctatattatataaatagtatttcagacactatgtagtctgttagattttataaagattggtagttatctgagcttaaacattttctcaattgtaaaataggtgggcacaagtattacacatcagaaaatcctgacaaaagggacacatagtgtttgtaacaccgtccaacattccttgtttgtaagtgttgtatgtaccgttgatgttgataaaaagaaagtttatatcttgattattttgttgtctaaagctaaacaaaacttgcatgcagcagcttttgactgtttccagagtgcttataatatacataactccctggaaataactgagcactttgaattttttttatgtctaaaattgtcagttaatttattattttgtttgagtaagaattttaatattgccatattctgtagtatttttctttgtatatttctagtatggcacatgatatgagtcactgcctttttttctatggtgtatgacagttagagatgctgattttttttctgataaattctttctttgagaaagacaattttaatgtttacaacaataaacctgtgtacgcgacaaacttatttgtgctttgtcattatctaacaatattcgtgaaacaccgtctgatat

SEQ ID NO: 308082 - DNA, 3490 bp, Homo sapiens
agtgcaatgggtggtattttctgttgtttcaagtcatttcttttatacattcattttaagtgctatgtttggtaaaggcttcccactcatttccaatgagacaaacagggaaggcatggaagggcctgcctggtgagtctacatatgcccagctgaatctctgtcgggaagaaaccctgaagcttcctgtgtctgtatttcagggaggagattggacaggctggactccccattgcttttctaaaaatcttggaaactttgtccttcattgaattacgacactgtccacctttaatttcctcgaaaacgcctgtaactcggctgaagccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataaggtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgcaaaaaaaaagaaaataaatacataaaaaagggacaagcatgttgattctaggttgaaaatgttataggcacttgctacttcagtaatgtctatattatataaatagtatttcagacactatgtagtctgttagattttataaagattggtagttatctgagcttaaacattttctcaattgtaaaataggtgggcacaagtattacacatcagaaaatcctgacaaaagggacacatagtgtttgtaacaccgtccaacattccttgtttgtaagtgttgtatgtaccgttgatgttgataaaaagaaagtttatatcttgattattttgttgtctaaagctaaacaaaacttgcatgcagcagcttttgactgtttccagagtgcttataatatacataactccctggaaataactgagcactttgaattttttttatgtctaaaattgtcagttaatttattattttgtttgagtaagaattttaatattgccatattctgtagtatttttctttgtatatttctagtatggcacatgatatgagtcactgcctttttttctatggtgtatgacagttagagatgctgattttttttctgataaattctttctttgagaaagacaattttaatgtttacaacaataaacctgtgtacgcgacaaacttatttgtgctttgtcattatctaacaatattcgtgaaacaccgtctgatat

SEQ ID NO: 308083 - DNA, 3468 bp, Homo sapiens
  misc_feature (1)..(3): n is a, c, g, or t
  misc_feature (6)..(6): n is a, c, g, or t
  misc_feature (8)..(8): n is a, c, g, or t
nnnacnangggcacattggcggccagggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagagagacgcggagaactcctaaggaggagattggacaggctggactccccattgcttttctaaaaatcttggaaactttgtccttcattgaattacgacactgtccacctttaatttcctcgcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataaggtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgcaaaaaaaaagaaaataaatacataaaaaagggacaagcatgttgattctaggttgaaaatgttataggcacttgctacttcagtaatgtctatattatataaatagtatttcagacactatgtagtctgttagattttataaagattggtagttatctgagcttaaacattttctcaattgtaaaataggtgggcacaagtattacacatcagaaaatcctgacaaaagggacacatagtgtttgtaacaccgtccaacattccttgtttgtaagtgttgtatgtaccgttgatgttgataaaaagaaagtttatatcttgattattttgttgtctaaagctaaacaaaacttgcatgcagcagcttttgactgtttccagagtgcttataatatacataactccctggaaataactgagcactttgaattttttttatgtctaaaattgtcagttaatttattattttgtttgagtaagaattttaatattgccatattctgtagtatttttctttgtatatttctagtatggcacatgatatgagtcactgcctttttttctatggtgtatgacagttagagatgctgattttttttctgataaattctttctttgagaaagacaattttaatgtttacaacaataaacctgtgtacgcgacaaacttatttgtgctttgtcattatctaacaatattcgtgaaacaccgtctgatat

SEQ ID NO: 308084 - DNA, 3539 bp, Homo sapiens
ggctgtacgcgcggaatttcgggatgggcagatcgtccggcggtcgtgcactgtcagcagtcctttgcctgtcacccggtcgcctgtcctctcctccctcgtgaggtgtcgggttccttcgccaactctcccagcccctatctctgatcccgaatacacggactcccaaattggatctgcatcttcgcatgagctcatatcacactgatagatggccgcggaccaacattcgtactgaggacattggatggagttgacatccccctcgctcttactaaatattcttgcagtgtttgtccttcatagaattgctgacactgtgctaacctttaatcttcggcatctaaaaacgcaacttgtaacttacgcgctgaagccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataaggtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgcaaaaaaaaagaaaataaatacataaaaaagggacaagcatgttgattctaggttgaaaatgttataggcacttgctacttcagtaatgtctatattatataaatagtatttcagacactatgtagtctgttagattttataaagattggtagttatctgagcttaaacattttctcaattgtaaaataggtgggcacaagtattacacatcagaaaatcctgacaaaagggacacatagtgtttgtaacaccgtccaacattccttgtttgtaagtgttgtatgtaccgttgatgttgataaaaagaaagtttatatcttgattattttgttgtctaaagctaaacaaaacttgcatgcagcagcttttgactgtttccagagtgcttataatatacataactccctggaaataactgagcactttgaattttttttatgtctaaaattgtcagttaatttattattttgtttgagtaagaattttaatattgccatattctgtagtatttttctttgtatatttctagtatggcacatgatatgagtcactgcctttttttctatggtgtatgacagttagagatgctgattttttttctgataaattctttctttgagaaagacaattttaatgtttacaacaataaacctgtgtacgcgacaaacttatttgtgctttgtcattatctaacaatattcgtgaaacaccgtctgatat

SEQ ID NO: 308085 - DNA, 3880 bp, Homo sapiens
  misc_feature (1)..(3): n is a, c, g, or t
  misc_feature (6)..(6): n is a, c, g, or t
  misc_feature (8)..(8): n is a, c, g, or t
nnnacnangggcacattggcggccagggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagagagacgcggagaactcctaaggaggagattggacaggctggactccccattgcttttctaaaaatcttggaaactttgtccttcattgaattacgacactgtccacctttaatttcctcgaaaacgcctgtaactcggctgaaggttagtgcaacttcatttctttcctttactctccagagctccccaaacatcaagaaacaggacaaggcaaaccctgtaacttaaggtttgcccgacccatcgccttcgggaacaactttctcattgtgaaattcaacttcatttctagatggtcatttctagaaagagactgctgaatctgagcttcagagaagaggctcatctgagtgggatgagtgggggggtatgagggagatgtttggaaatacccaggagtgtagaccctcagtagctttttagctctgggtctttatttggttagtctttccacgccctaaactgttgttctgcagcattctctctctcctgcctttcctctcgcgcccctacatgctctctgactgccgcgggctgccggtgtagctccaggtgtacccgagcccgggagaaagtgttcagttgaccaggctgagtgtgttatcaccctgtttcatttccagccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataaggtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgcaaaaaaaaagaaaataaatacataaaaaagggacaagcatgttgattctaggttgaaaatgttataggcacttgctacttcagtaatgtctatattatataaatagtatttcagacactatgtagtctgttagattttataaagattggtagttatctgagcttaaacattttctcaattgtaaaataggtgggcacaagtattacacatcagaaaatcctgacaaaagggacacatagtgtttgtaacaccgtccaacattccttgtttgtaagtgttgtatgtaccgttgatgttgataaaaagaaagtttatatcttgattattttgttgtctaaagctaaacaaaacttgcatgcagcagcttttgactgtttccagagtgcttataatatacataactccctggaaataactgagcactttgaattttttttatgtctaaaattgtcagttaatttattattttgtttgagtaagaattttaatattgccatattctgtagtatttttctttgtatatttctagtatggcacatgatatgagtcactgcctttttttctatggtgtatgacagttagagatgctgattttttttctgataaattctttctttgagaaagacaattttaatgtttacaacaataaacctgtgtacgcgacaaacttatttgtgctttgtcattatctaacaatattcgtgaaacaccgtctgatat

SEQ ID NO: 308086 - DNA, 2294 bp, Homo sapiens
tgaatactaacatgtcaattgttttgtggagataagagtgaacgtttcccagggctggatggcactgtatttagtctgtatggaaatggcaatttacatatttaaagcagcgacctcgtagcaccatccctaattgaattaattgccccggaacatctaatttccttactggtcagagagaggtttaattgttataaaaacctggctcccctattagaaacggggttagcaatttcacgggttatatattttagagaacctcattaagtgctttttaaaatgaaattccagttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataaggtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgcaaaaaaaaagaaaataaatacataaaaaagggacaagcatgttgattctaggttgaaaatgttataggcacttgctacttcagtaatgtctatattatataaatagtatttcagacactatgtagtctgttagattttataaagattggtagttatctgagcttaaacattttctcaattgtaaaataggtgggcacaagtattacacatcagaaaatcctgacaaaagggacacatagtgtttgtaacaccgtccaacattccttgtttgtaagtgttgtatgtaccgttgatgttgataaaaagaaagtttatatcttgattattttgttgtctaaagctaaacaaaacttgcatgcagcagcttttgactgtttccagagtgcttataatatacataactccctggaaataactgagcactttgaattttttttatgtctaaaattgtcagttaatttattattttgtttgagtaagaattttaatattgccatattctgtagtatttttctttgtatatttctagtatggcacatgatatgagtcactgcctttttttctatggtgtatgacagttagagatgctgattttttttctgataaattctttctttgagaaagacaattttaatgtttacaacaataaacctgtgtacgcgacaaacttatttgtgctttgtcattatctaacaatattcgtgaaacaccgtctgatat

SEQ ID NO: 308087 - DNA, 3853 bp, Homo sapiens
  misc_feature (1)..(3): n is a, c, g, or t
  misc_feature (6)..(6): n is a, c, g, or t
  misc_feature (8)..(8): n is a, c, g, or t
nnnacnangggcacattggcggccagggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagagagacgcggagaactcctaaggaggagattggacaggctggactccccattgcttttctaaaaatcttggaaactttgtccttcattgaattacgacactgtccacctttaatttcctcgaaaacgcctgtaactcggctgaaggttagtgcaacttcatttctttcctttactctccagagctccccaaacatcaagaaacaggacaaggcaaaccctgtaacttaaggtttgcccgacccatcgccttcgggaacaactttctcattgtgaaattcaacttcatttctagatggtcatttctagaaagagactgctgaatctgagcttcagagaagaggctcatctgagtgggatgagtgggggggtatgagggagatgtttggaaatacccaggagtgtagaccctcagtagctttttagctctgggtctttatttggttagtctttccacgccctaaactgttgttctgcagcattctctctctcctgcctttcctctcgcgcccctacatgctctctgactgccgcgggctgccggtgtagctccaggtgtacccgagcccgggagaaagtgttcagttgaccaggctgagtgtgttatcaccctgtttcatttccagccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataaggtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgcaaaaaaaaagaaaataaatacataaaaaagggacaagcatgttgattctaggttgaaaatgttataggcacttgctacttcagtaatgtctatattatataaatagtatttcagacactatgtagtctgttagattttataaagattggtagttatctgagcttaaacattttctcaattgtaaaataggtgggcacaagtattacacatcagaaaatcctgacaaaagggacacatagtgtttgtaacaccgtccaacattccttgtttgtaagtgttgtatgtaccgttgatgttgataaaaagaaagtttatatcttgattattttgttgtctaaagctaaacaaaacttgcatgcagcagcttttgactgtttccagagtgcttataatatacataactccctggaaataactgagcactttgaattttttttatgtctaaaattgtcagttaatttattattttgtttgagtaagaattttaatattgccatattctgtagtatttttctttgtatatttctagtatggcacatgatatgagtctgtattaactgcttggggatcct

SEQ ID NO: 308088 - DNA, 3948 bp, Homo sapiens
  misc_feature (1)..(3): n is a, c, g, or t
  misc_feature (6)..(6): n is a, c, g, or t
  misc_feature (8)..(8): n is a, c, g, or t
nnnacnangggcacattggcggccagggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagagagacgcggagaactcctaaggaggagattggacaggctggactccccattgcttttctaaaaatcttggaaactttgtccttcattgaattacgacactgtccacctttaatttcctcgaaaacgcctgtaactcggctgaaggttagtgcaacttcatttctttcctttactctccagagctccccaaacatcaagaaacaggacaaggcaaaccctgtaacttaaggtttgcccgacccatcgccttcgggaacaactttctcattgtgaaattcaacttcatttctagatggtcatttctagaaagagactgctgaatctgagcttcagagaagaggctcatctgagtgggatgagtgggggggtatgagggagatgtttggaaatacccaggagtgtagaccctcagtagctttttagctctgggtctttatttggttagtctttccacgccctaaactgttgttctgcagcattctctctctcctgcctttcctctcgcgcccctacatgctctctgactgccgcgggctgccggtgtagctccaggtgtacccgagcccgggagaaagtgttcagttgaccaggctgagtgtgttatcaccctgtttcatttccagccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataaggtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgcaaaaaaaaagaaaataaatacataaaaaagggacaagcatgttgattctaggttgaaaatgttataggcacttgctacttcagtaatgtctatattatataaatagtatttcagacactatgtagtctgttagattttataaagattggtagttatctgagcttaaacattttctcaattgtaaaataggtgggcacaagtattacacatcagaaaatcctgacaaaagggacacatagtgtttgtaacaccgtccaacattccttgtttgtaagtgttgtatgtaccgttgatgttgataaaaagaaagtttatatcttgattattttgttgtctaaagctaaacaaaacttgcatgcagcagcttttgactgtttccagagtgcttataatatacataactccctggaaataactgagcactttgaattttttttatgtcatattctgtagtatttttctttgtatatttctagtatggcacatgatatgagtcactgcctttttttctatggtgtatgacagttagagatgctgattttttttctgataaattctttctttgagaaagacaattttaatgtttacaacaataaacctgtgtacgcgacaaacttatttgtgctttgtcattatctaacaatattcgtgaaacaccgtctgatat

SEQ ID NO: 308089 - DNA, 3946 bp, Homo sapiens
  misc_feature (1)..(3): n is a, c, g, or t
  misc_feature (6)..(6): n is a, c, g, or t
  misc_feature (8)..(8): n is a, c, g, or t
nnnacnangggcacattggcggccagggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagagagacgcggagaactcctaaggaggagattggacaggctggactccccattgcttttctaaaaatcttggaaactttgtccttcattgaattacgacactgtccacctttaatttcctcgaaaacgcctgtaactcggctgaaggttagtgcaacttcatttctttcctttactctccagagctccccaaacatcaagaaacaggacaaggcaaaccctgtaacttaaggtttgcccgacccatcgccttcgggaacaactttctcattgtgaaattcaacttcatttctagatggtcatttctagaaagagactgctgaatctgagcttcagagaagaggctcatctgagtgggatgagtgggggggtatgagggagatgtttggaaatacccaggagtgtagaccctcagtagctttttagctctgggtctttatttggttagtctttccacgccctaaactgttgttctgcagcattctctctctcctgcctttcctctcgcgcccctacatgctctctgactgccgcgggctgccggtgtagctccaggtgtacccgagcccgggagaaagtgttcagttgaccaggctgagtgtgttatcaccctgtttcatttccagccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataaggtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgcaaaaaaaaagaaaataaatacataaaaaagggacaagcatgttgattctaggttgaaaatgttataggcacttgctacttcagtaatgtctatattatataaatagtatttcagacactatgtagtctgttagattttataaagattggtagttatctgagcttaaacattttctcaattgtaaaataggtgggcacaagtattacacatcagaaaatcctgacaaaagggacacatagtgtttgtaacaccgtccaacattccttgtttgtaagtgttgtatgtaccgttgatgtttgcatgcagcagcttttgactgtttccagagtgcttataatatacataactccctggaaataactgagcactttgaattttttttatgtctaaaattgtcagttaatttattattttgtttgagtaagaattttaatattgccatattctgtagtatttttctttgtatatttctagtatggcacatgatatgagtcactgcctttttttctatggtgtatgacagttagagatgctgattttttttctgataaattctttctttgagaaagacaattttaatgtttacaacaataaacctgtgtacgcgacaaacttatttgtgctttgtcattatctaacaatattcgtgaaacaccgtctgatat

SEQ ID NO: 308090 - DNA, 2551 bp, Homo sapiens
  misc_feature (1)..(3): n is a, c, g, or t
  misc_feature (6)..(6): n is a, c, g, or t
  misc_feature (8)..(8): n is a, c, g, or t
nnnacnangggcacattggcggccagggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagagagacgcggagaactcctaaggaggagattggacaggctggactccccattgcttttctaaaaatcttggaaactttgtccttcattgaattacgacactgtccacctttaatttcctcgaaaacgcctgtaactcggctgaaggttagtgcaacttcatttctttcctttactctccagagctccccaaacatcaagaaacaggacaaggcaaaccctgtaacttaaggtttgcccgacccatcgccttcgggaacaactttctcattgtgaaattcaacttcatttctagatggtcatttctagaaagagactgctgaatctgagcttcagagaagaggctcatctgagtgggatgagtgggggggtatgagggagatgtttggaaatacccaggagtgtagaccctcagtagctttttagctctgggtctttatttggttagtctttccacgccctaaactgttgttctgcagcattctctctctcctgcctttcctctcgcgcccctacatgctctctgactgccgcgggctgccggtgtagctccaggtgtacccgagcccgggagaaagtgttcagttgaccaggctgagtgtgttatcaccctgtttcatttccagccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtaataagggagggaggagacaatccagggaggctgtgagagaaatcaagaaaggaaaagaaagggaggaagggaaaccagagggtggggtagagaaaaagacagaataggaaatggaagtcggagaaaggaagaaaaagaaagaaaacaaaaaaagacgagaagaagcgagcccagaagccttggatgaatggaatggaggtgggatagggggcgttcttgattgttatgaaattaaaccctttcaaggtccactggtctacattttattaactcttcagtaattaggtgactcttaaatccctcatttattgctcttcaagtaattagttgtttagcttttctctctc

SEQ ID NO: 308091 - DNA, 520 bp, Homo sapiens
agagaaaaagacagaataggaaatggaagtcggagaaaggaagaaaaagaaagaaaacaaaaaaagacgagaagaagcgagcccagaagccttggatgaatggaatggaggtgggatagggggcgttcttgattgttatgaaattaaaccctttcaaggtccactggtctacattttattaactcttcagtaattaggtgactcttaaatccctcatttattgctcttcaagtaattagttgtttagcttttctctctctctttttctcccctctctctctttggtattaattgcaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacaggtcagtactgcaggcgcagggcgcttcccctccagaactgccta

SEQ ID NO: 308092 - DNA, 598 bp, Homo sapiens
ctactactactaaattcgcggcctgctcgacagcactacaagaaatatttgatggtatacaaccaaaaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggttccatcaatggtgagcaccagcctgaatgcagaagcgctccagtatctccaagggtaccttcaggcagccagtgtgacactgctttaaactgcatttttttgtcacgaattccatcttgtaaaggatattaaatgttgctttaacctgaa

SEQ ID NO: 308093 - DNA, 805 bp, Homo sapiens
cggacggtggacgaaaacacccgacctaccgcacgcggagatatatacttcagtgccaaaagaacatcttttagtctcgattcctctcttgattaatcatcttcaagctgaaagtattgttgttcatacttacgcagctcatgctcttgaacggctctttactatgcgagggcctaacaatgccactctctttacagctgcagaaatcgcaccgtttgttgagattctgctaacaaaccttttcaaagctctcacacttcctggctcttcagaaaatgaatatattatgaaagaacccaagcaaacctcactttaatcactacatgtttgaagcaatatgtttatccataagaataacttgcaaagctaaccctgctgctgttgtaaattttgaggaggctttgtttttggtgtttactgaaattctacctattgatgcgcatgaatttataccatactattttaaagtgagattctccctttctatattcacccgtcagcgaaatatcatcattcctatatgggcatcatttcccacgttgtttatgcatttttttggaaagaaactgatgtattactgataaaagtatgatattaaagcttcttacgtaccctggctaaatagattaccaggcggtgcacccaccataactctccgttctgtgttactttccgagctgcgcgaaaatatggcgaatgtccattcgggctttagtacaaacatcacagcacattctcctctttgaattatctctacctactattataatattcgttccgattgaccaaaatattaatattttga

SEQ ID NO: 308094 - DNA, 467 bp, Homo sapiens
gcattcctggccccgccccctgcagcgggccgctcgctcatgcgctctggcctcaggctcgctgtcgcgccattttgccggggtttgaatgtgaggcggagcggcggcaggagcgggtagtgccagctacggtccgcggctggggttccctcctccgtttctgtatccccacgagatcctatagcaatggaactcagcgatgcaaatctgcaaacactaacagaatatttaaagaaaacacttgatcctgatcctgccatccgacgtccagctgagaaatttcttgaatctgttgaaggaaatcagaattatccactgttgcttttgacattactggagaagtcccaggataatgttatcaaagtatgtgcttcagtaacattcaaaaactatattaaaaggaactggagaatttgaagatgaaccaaaccttagcagcccagagcttcagaagcagttaagtgtgc

SEQ ID NO: 308095 - DNA, 3683 bp, Homo sapiens
gcattcctggccccgccccctgcagcgggccgctcgctcatgcgctctggcctcaggctcgctgtcgcgccattttgccggggtttgaatgtgaggcggagcggcggcaggagcgggtagtgccagctacggtccgcggctggggttccctcctccgtttctgtatccccacgagatcctatagcaatggaactcagcgatgcaaatctgcaaacactaacagaatatttaaagaaaacacttgatcctgatcctgccatccgacgtccagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgttgaagatgaaccaaacaaaatttgtgaagccgatcgagtggccattaaagccaacatagtgcacttgatgcttagcagcccagagcaaattcagaagcagttaagtgatgcaattagcattattggcagagaagattttccacagaaatggcctgacttgctgacagaaatggtgaatcgctttcagagtggagatttccatgttattaatggagtcctccgtacagcacattcattatttaaaagataccgtcatgaatttaagtcaaacgagttatggactgaaattaagcttgttctggatgcctttgctttgcctttgactaatctttttaaggccactattgaactctgcagtacccatgcaaatgatgcctctgccctgaggattctgttttcttccctgatcctgatctcaaaattgttctatagtttaaactttcaggatctccctgaattttttgaagataatatggaaacttggatgaataattttcatactctcttaacattggataataagcttttacaaactgatgatgaagaggaagccggcttattggagctcttaaaatcccagatttgtgataatgccgcactctatgcacaaaagtacgatgaagaattccagcgatacctgcctcgttttgttacagccatctggaatttactagttacaacgggtcaagaggttaaatatgatttgttggtaagtaatgcaattcaatttctggcttcagtttgtgagagacctcattataagaatctatttgaggaccagaacacgctgacaagtatctgtgaaaaggttattgtgcctaacatggaatttagagctgctgatgaagaagcatttgaagataattctgaggagtacataaggagagatttggaaggatctgatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaagcccaaacacagaagcatggaattacacaagcaaatgaacttgtaaacctaactgagttctttgtgaatcacatcctccctgatttaaaatcagctaatgtgaatgaatttcctgtccttaaagctgacggtatcaaatatattatgatttttagaaatcaagtgccaaaagaacatcttttagtctcgattcctctcttgattaatcatcttcaagctgaaagtattgttgttcatacttacgcagctcatgctcttgaacggctctttactatgcgagggcctaacaatgccactctctttacagctgcagaaatcgcaccgtttgttgagattctgctaacaaaccttttcaaagctctcacacttcctggctcttcagaaaatgaatatattatgaaagctatcatgagaagtttttctctcctacaagaagccataatcccctacatccctactctcatcactcagcttacacagaagctattagctgttagtaagaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatgatgtgcaagaatttattccatacgtctttcaagtgatgtctttgcttctggaaacacacaaaaatgacatcccgtcttcctatatggccttatttcctcatctccttcagccagtgctttgggaaagaacaggaaatattcctgctctagtgaggcttcttcaagcattcttagaacgcggttcaaacacaatagcaagtgctgcagctgacaaaattcctgggttactaggtgtctttcagaagctgattgcatccaaagcaaatgaccaccaaggtttttatcttctaaacagtataatagagcacatgcctcctgaatcagttgaccaatataggaaacaaatcttcattctgctattccagagacttcagaattccaaaacaaccaagtttatcaagagttttttagtctttattaatttgtattgcataaaatatggggcactagcactacaagaaatatttgatggtatacaaccaaaaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaaccttgagcaaattagttggtttgtgtgatcatacagttatgtgggtggcttctagtttgcaacttcaagggacaagtattaatagttcagtgtatggcgttggtttgtgttgagcgtttgcacggtttggataatcttaaattttgacggacactgtggagactttctgttactaaatccttttgttttgaagctgttgctatttgtatttctcttgtcctttatattttttgtctgtttatttacgcttttattggaaatgtgaataagtaaagaattacttgtgttacttgccaagcagtgcacatttcatagtttcaaatctgtaatcagcaataaaaatcctaaaatatgtacctaagaacatcttaagggcaggttttcagtgctctctcatgcttttataaaaatgaagaatttctttaaatttc

SEQ ID NO: 308096 - DNA, 4131 bp, Homo sapiens
gcattcctggccccgccccctgcagcgggccgctcgctcatgcgctctggcctcaggctcgctgtcgcgccattttgccggggtttgaatgtgaggcggagcggcggcaggagcgggtagtgccagctacggtccgcggctggggttccctcctccgtttctgtatccccacgagatcctatagcaatggaactcagcgatgcaaatctgcaaacactaacagaatatttaaagaaaacacttgatcctgatcctgccatccgacgtccagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgttgaagatgaaccaaacaaaatttgtgaagccgatcgagtggccattaaagccaacatagtgcacttgatgcttagcagcccagagcaaattcagaagcagttaagtgatgcaattagcattattggcagagaagattttccacagaaatggcctgacttgctgacagaaatggtgaatcgctttcagagtggagatttccatgttattaatggagtcctccgtacagcacattcattatttaaaagataccgtcatgaatttaagtcaaacgagttatggactgaaattaagcttgttctggatgcctttgctttgcctttgactaatctttttaaggccactattgaactctgcagtacccatgcaaatgatgcctctgccctgaggattctgttttcttccctgatcctgatctcaaaattgttctatagtttaaactttcaggatctccctgaattttttgaagataatatggaaacttggatgaataattttcatactctcttaacattggataataagcttttacaaactgatgatgaagaggaagccggcttattggagctcttaaaatcccagatttgtgataatgccgcactctatgcacaaaagtacgatgaagaattccagcgatacctgcctcgttttgttacagccatctggaatttactagttacaacgggtcaagaggttaaatatgatttgttggtaagtaatgcaattcaatttctggcttcagtttgtgagagacctcattataagaatctatttgaggaccagaacacgctgacaagtatctgtgaaaaggttattgtgcctaacatggaatttagagctgctgatgaagaagcatttgaagataattctgaggagtacataaggagagatttggaaggatctgatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaagcccaaacacagaagcatggaattacacaagcaaatgaacttgtaaacctaactgagttctttgtgaatcacatcctccctgatttaaaatcagctaatgtgaatgaatttcctgtccttaaagctgacggtatcaaatatattatgatttttagaaatcaagtgccaaaagaacatcttttagtctcgattcctctcttgattaatcatcttcaagctgaaagtattgttgttcatacttacgcagctcatgctcttgaacggctctttactatgcgagggcctaacaatgccactctctttacagctgcagaaatcgcaccgtttgttgagattctgctaacaaaccttttcaaagctctcacacttcctggctcttcagaaaatgaatatattatgaaagctatcatgagaagtttttctctcctacaagaagccataatcccctacatccctactctcatcactcagcttacacagaagctattagctgttagtaagaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatgatgtgcaagaatttattccatacgtctttcaagtgatgtctttgcttctggaaacacacaaaaatgacatcccgtcttcctatatggccttatttcctcatctccttcagccagtgctttgggaaagaacaggaaatattcctgctctagtgaggcttcttcaagcattcttagaacgcggttcaaacacaatagcaagtgctgcagctgacaaaattcctgggttactaggtgtctttcagaagctgattgcatccaaagcaaatgaccaccaaggtttttatcttctaaacagtataatagagcacatgcctcctgaatcagttgaccaatataggaaacaaatcttcattctgctattccagagacttcagaattccaaaacaaccaagtttatcaagagttttttagtctttattaatttgtattgcataaaatatggggcactagcactacaagaaatatttgatggtatacaaccaaaaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaaccttgagcaaattagttggtttgtgtgatcatacagttatgtgggtggcttctagtttgcaacttcaagggacaagtattaatagttcagtgtatggcgttggtttgtgttgagcgtttgcacggtttggataatcttaaattttgacggacactgtggagactttctgttactaaatccttttgttttgaagctgttgctatttgtatttctcttgtcctttatattttttgtctgtttatttacgcttttattggaaatgtgaataagtaaagaattacttgtgttacttgccaagcagtgcacatttcatagtttcaaatctgtaatcagcaataaaaatcctaaaatatgtacctaaaaaaaaaaaaaaaaaaaaaaaaaaaaaaaaaaaaaaacacaaacaaaaaaaacaaaaaaaacacaacaacaaaaaacaacaaaagagagggggggggggcgcgccaaaaaaacaccccgggggggcggcccttccccacccccttttttttaaaaagggggcccccccaaagaggggagcaaaaaagggaggggggggcggagaaaaaaccaggggtggcgagggaacaacgctacgtcggggtcacttgtagaagaagacaccccccattgtgcgtcgggcacaagtggcgacgccacccccagcaaattaagaggagcggaggaataacaaactgggttcgagctgcgacccccgccgtttagctgccgggaaactgtctctccgttttttgtaagtagccgggtcttctatactaacaacgcgacgacgcccagacggcgcgtgactgacgccagccgcgacaaaacttacccgaaaaccacacgactgaacacgacacgaagacactacaatga

SEQ ID NO: 308097 - DNA, 3252 bp, Homo sapiens
gcattcctggccccgccccctgcagcgggccgctcgctcatgcgctctggcctcaggctcgctgtcgcgccattttgccggggtttgaatgtgaggcggagcggcggcaggagcgggtagtgccagctacggtccgcggctggggttccctcctccgtttctgtatccccacgagatcctatagcaatggaactcagcgatgcaaatctgcaaacactaacagaatatttaaagaaaacacttgatcctgatcctgccatccgacgtccagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgttgaagatgaaccaaacaaaatttgtgaagccgatcgagtggccattaaagccaacatagtgcacttgatgcttagcagcccagagcaaattcagaagcagttaagtgatgcaattagcattattggcagagaagattttccacagaaatggcctgacttgctgacagaaatggtgaatcgctttcagagtggagatttccatgttattaatggagtcctccgtacagcacattcattatttaaaagataccgtcatgaatttaagtcaaacgagttatggactgaaattaagcttgttctggatgcctttgctttgcctttgactaatctttttaaggccactattgaactctgcagtacccatgcaaatgatgcctctgccctgaggattctgttttcttccctgatcctgatctcaaaattgttctatagtttaaactttcaggatctccctgaattttttgaagataatatggaaacttggatgaataattttcatactctcttaacattggataataagcttttacaaactgatgatgaagaggaagccggcttattggagctcttaaaatcccagatttgtgataatgccgcactctatgcacaaaagtacgatgaagaattccagcgatacctgcctcgttttgttacagccatctggaatttactagttacaacgggtcaagaggttaaatatgatttgttggtaagtaatgcaattcaatttctggcttcagtttgtgagagacctcattataagaatctatttgaggaccagaacacgctgacaagtatctgtgaaaaggttattgtgcctaacatggaatttagagctgctgatgaagaagcatttgaagataattctgaggagtacataaggagagatttggaaggatctgatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaagcccaaacacagaagcatggaattacacaagcaaatgaacttgtaaacctaactgagttctttgtgaatcacatcctccctgatttaaaatcagctaatgtgaatgaatttcctgtccttaaagctgacggtatcaaatatattatgatttttagaaatcaagtgccaaaagaacatcttttagtctcgattcctctcttgattaatcatcttcaagctgaaagtattgttgttcatacttacgcagctcatgctcttgaacggctctttactatgcgagggcctaacaatgccactctctttacagctgcagaaatcgcaccgtttgttgagattctgctaacaaaccttttcaaagctctcacacttcctggctcttcagaaaatgaatatattatgaaagctatcatgagaagtttttctctcctacaagaagccataatcccctacatccctactctcatcactcagcttacacagaagctattagctgttagtaagaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatgatgtgcaagaatttattccatacgtctttcaagtgatgtctttgcttctggaaacacacaaaaatgacatcccgtcttcctatatggccttatttcctcatctccttcagccagtgctttgggaaagaacaggaaatattcctgctctagtgaggcttcttcaagcattcttagaacgcggttcaaacacaatagcaagtgctgcagctgacaaaattcctgggttactaggtgtctttcagaagctgattgcatccaaagcaaatgaccaccaaggtttttatcttctaaacagtataatagagcacatgcctcctgaatcagttgaccaatataggaaacaaatcttcattctgctattccagagacttcagaattccaaaacaaccaagtttatcaagagttttttagtctttattaatttgtattgcataaaatatggggcactagcactacaagaaatatttgatggtatacaaccaaaaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaa

SEQ ID NO: 308098 - DNA, 3936 bp, Homo sapiens
gcattcctggccccgccccctgcagcgggccgctcgctcatgcgctctggcctcaggctcgctgtcgcgccattttgccggggtttgaatgtgaggcggagcggcggcaggagcgggtagtgccagctacggtccgcggctggggttccctcctccgtttctgtatccccacgagatcctatagcaatggaactcagcgatgcaaatctgcaaacactaacagaatatttaaagaaaacacttgatcctgatcctgccatccgacgtccagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgttgaagatgaaccaaacaaaatttgtgaagccgatcgagtggccattaaagccaacatagtgcacttgatgcttagcagcccagagcaaattcagaagcagttaagtgatgcaattagcattattggcagagaagattttccacagaaatggcctgacttgctgacagaaatggtgaatcgctttcagagtggagatttccatgttattaatggagtcctccgtacagcacattcattatttaaaagataccgtcatgaatttaagtcaaacgagttatggactgaaattaagcttgttctggatgcctttgctttgcctttgactaatctttttaaggccactattgaactctgcagtacccatgcaaatgatgcctctgccctgaggattctgttttcttccctgatcctgatctcaaaattgttctatagtttaaactttcaggatctccctgaattttttgaagataatatggaaacttggatgaataattttcatactctcttaacattggataataagcttttacaaactgatgatgaagaggaagccggcttattggagctcttaaaatcccagatttgtgataatgccgcactctatgcacaaaagtacgatgaagaattccagcgatacctgcctcgttttgttacagccatctggaatttactagttacaacgggtcaagaggttaaatatgatttgttggtaagtaatgcaattcaatttctggcttcagtttgtgagagacctcattataagaatctatttgaggaccagaacacgctgacaagtatctgtgaaaaggttattgtgcctaacatggaatttagagctgctgatgaagaagcatttgaagataattctgaggagtacataaggagagatttggaaggatctgatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaagcccaaacacagaagcatggaattacacaagcaaatgaacttgtaaacctaactgagttctttgtgaatcacatcctccctgatttaaaatcagctaatgtgaatgaatttcctgtccttaaagctgacggtatcaaatatattatgatttttagaaatcaagtgccaaaagaacatcttttagtctcgattcctctcttgattaatcatcttcaagctgaaagtattgttgttcatacttacgcagctcatgctcttgaacggctctttactatgcgagggcctaacaatgccactctctttacagctgcagaaatcgcaccgtttgttgagattctgctaacaaaccttttcaaagctctcacacttcctggctcttcagaaaatgaatatattatgaaagctatcatgagaagtttttctctcctacaagaagccataatcccctacatccctactctcatcactcagcttacacagaagctattagctgttagtaagaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatgatgtgcaagaatttattccatacgtctttcaagtgatgtctttgcttctggaaacacacaaaaatgacatcccgtcttcctatatggccttatttcctcatctccttcagccagtgctttgggaaagaacaggaaatattcctgctctagtgaggcttcttcaagcattcttagaacgcggttcaaacacaatagcaagtgctgcagctgacaaaattcctgggttactaggtgtctttcagaagctgattgcatccaaagcaaatgaccaccaaggtttttatcttctaaacagtataatagagcacatgcctcctgaatcagttgaccaatataggaaacaaatcttcattctgctattccagagacttcagaattccaaaacaaccaagtttatcaagagttttttagtctttattaatttgtattgcataaaatatggggcactagcactacaagaaatatttgatggtatacaaccaaaaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaaccttgagcaaattagttggtttgtgtgatcatacagttatgtgggtggcttctagtttgcaacttcaagggacaagtattaatagttcagtgtatggcgttggtttgtgttgagcgtttgcacggtttggataatcttaaattttgacggacactgtggagactttctgttactaaatccttttgttttgaagctgttgctatttgtatttctcttgtcctttatattttttgtctgtttatttacgcttttattggaaatgtgaataagtaaagaattacttgtgttacttgccaagcagtgcacatttcatagtttcaaatctgtaatcagcaataaaaaaaaaaaaaaaaaaaaaaaaaatttggggggggctgaggcgaaaagttttaaaacacaagttggggggggggacccaaaagtacgtgcaaccctgggcacacgggggtccacaaaagacaacccgggccctgaaacaggcgcgtgggttccccaccaataaaaaaagccgcgggcaaccccgggtcttggaaccacccaaaggatgatgaaaggcacaggcgcctacaacgggcccaaggaccgataatgacgcgaccgagtgaagaagcgaagagggagacaagaacacacaagacaccacagagacacacagcaacacagcggacaccacaacagacaaag

SEQ ID NO: 308099 - DNA, 3749 bp, Homo sapiens
gcattcctggccccgccccctgcagcgggccgctcgctcatgcgctctggcctcaggctcgctgtcgcgccattttgccggggtttgaatgtgaggcggagcggcggcaggagcgggtagtgccagctacggtccgcggctggggttccctcctccgtttctgtatccccacgagatcctatagcaatggaactcagcgatgcaaatctgcaaacactaacagaatatttaaagaaaacacttgatcctgatcctgccatccgacgtccagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgttgaagatgaaccaaacaaaatttgtgaagccgatcgagtggccattaaagccaacatagtgcacttgatgcttagcagcccagagcaaattcagaagcagttaagtgatgcaattagcattattggcagagaagattttccacagaaatggcctgacttgctgacagaaatggtgaatcgctttcagagtggagatttccatgttattaatggagtcctccgtacagcacattcattatttaaaagataccgtcatgaatttaagtcaaacgagttatggactgaaattaagcttgttctggatgcctttgctttgcctttgactaatctttttaaggccactattgaactctgcagtacccatgcaaatgatgcctctgccctgaggattctgttttcttccctgatcctgatctcaaaattgttctatagtttaaactttcaggatctccctgaattttttgaagataatatggaaacttggatgaataattttcatactctcttaacattggataataagcttttacaaactgatgatgaagaggaagccggcttattggagctcttaaaatcccagatttgtgataatgccgcactctatgcacaaaagtacgatgaagaattccagcgatacctgcctcgttttgttacagccatctggaatttactagttacaacgggtcaagaggttaaatatgatttgttggtaagtaatgcaattcaatttctggcttcagtttgtgagagacctcattataagaatctatttgaggaccagaacacgctgacaagtatctgtgaaaaggttattgtgcctaacatggaatttagagctgctgatgaagaagcatttgaagataattctgaggagtacataaggagagatttggaaggatctgatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaagcccaaacacagaagcatggaattacacaagcaaatgaacttgtaaacctaactgagttctttgtgaatcacatcctccctgatttaaaatcagctaatgtgaatgaatttcctgtccttaaagctgacggtatcaaatatattatgatttttagaaatcaagtgccaaaagaacatcttttagtctcgattcctctcttgattaatcatcttcaagctgaaagtattgttgttcatacttacgcagctcatgctcttgaacggctctttactatgcgagggcctaacaatgccactctctttacagctgcagaaatcgcaccgtttgttgagattctgctaacaaaccttttcaaagctctcacacttcctggctcttcagaaaatgaatatattatgaaagctatcatgagaagtttttctctcctacaagaagccataatcccctacatccctactctcatcactcagcttacacagaagctattagctgttagtaagaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatgatgtgcaagaatttattccatacgtctttcaagtgatgtctttgcttctggaaacacacaaaaatgacatcccgtcttcctatatggccttatttcctcatctccttcagccagtgctttgggaaagaacaggaaatattcctgctctagtgaggcttcttcaagcattcttagaacgcggttcaaacacaatagcaagtgctgcagctgacaaaattcctgggttactaggtgtctttcagaagctgattgcatccaaagcaaatgaccaccaaggtttttatcttctaaacagtataatagagcacatgcctcctgaatcagttgaccaatataggaaacaaatcttcattctgctattccagagacttcagaattccaaaacaaccaagtttatcaagagttttttagtctttattaatttgtattgcataaaatatggggcactagcactacaagaaatatttgatggtatacaaccaaaaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaaaaaaaaaaaaaaaaaacacaaacaaaaaaaacaaaaaaaacacaacaacaaaaaacaacaaaagagagggggggggggcgcgccaaaaaaacaccccgggggggcggcccttccccacccccttttttttaaaaagggggcccccccaaagaggggagcaaaaaagggaggggggggcggagaaaaaaccaggggtggcgagggaacaacgctacgtcggggtcacttgtagaagaagacaccccccattgtgcgtcgggcacaagtggcgacgccacccccagcaaattaagaggagcggaggaataacaaactgggttcgagctgcgacccccgccgtttagctgccgggaaactgtctctccgttttttgtaagtagccgggtcttctatactaacaacgcgacgacgcccagacggcgcgtgactgacgccagccgcgacaaaacttacccgaaaaccacacgactgaacacgacacgaagacactacaatga

SEQ ID NO: 308100 - DNA, 3229 bp, Homo sapiens
tttagttgatgggcgagaaagtgctgtgggatgaaagttagatttactgccgatgaatatgatagtgaaatggattttggcgtaggtttggtctagggtgtagcctgagaataggggggccattcaacgcctccgtttctgtatcccacgagatcctatagcaatggaactcagcgatgcaaatctgcaaacactaacagaatatttaaagaaaacacttgatcctgatcctgccatccgacgtccagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgttgaagatgaaccaaacaaaatttgtgaagccgatcgagtggccattaaagccaacatagtgcacttgatgcttagcagcccagagcaaattcagaagcagttaagtgatgcaattagcattattggcagagaagattttccacagaaatggcctgacttgctgacagaaatggtgaatcgctttcagagtggagatttccatgttattaatggagtcctccgtacagcacattcattatttaaaagataccgtcatgaatttaagtcaaacgagttatggactgaaattaagcttgttctggatgcctttgctttgcctttgactaatctttttaaggccactattgaactctgcagtacccatgcaaatgatgcctctgccctgaggattctgttttcttccctgatcctgatctcaaaattgttctatagtttaaactttcaggatctccctgaattttttgaagataatatggaaacttggatgaataattttcatactctcttaacattggataataagcttttacaaactgatgatgaagaggaagccggcttattggagctcttaaaatcccagatttgtgataatgccgcactctatgcacaaaagtacgatgaagaattccagcgatacctgcctcgttttgttacagccatctggaatttactagttacaacgggtcaagaggttaaatatgatttgttggtaagtaatgcaattcaatttctggcttcagtttgtgagagacctcattataagaatctatttgaggaccagaacacgctgacaagtatctgtgaaaaggttattgtgcctaacatggaatttagagctgctgatgaagaagcatttgaagataattctgaggagtacataaggagagatttggaaggatctgatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaagcccaaacacagaagcatggaattacacaagcaaatgaacttgtaaacctaactgagttctttgtgaatcacatcctccctgatttaaaatcagctaatgtgaatgaatttcctgtccttaaagctgacggtatcaaatatattatgatttttagaaatcaagtgccaaaagaacatcttttagtctcgattcctctcttgattaatcatcttcaagctgaaagtattgttgttcatacttacgcagctcatgctcttgaacggctctttactatgcgagggcctaacaatgccactctctttacagctgcagaaatcgcaccgtttgttgagattctgctaacaaaccttttcaaagctctcacacttcctggctcttcagaaaatgaatatattatgaaagctatcatgagaagtttttctctcctacaagaagccataatcccctacatccctactctcatcactcagcttacacagaagctattagctgttagtaagaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatgatgtgcaagaatttattccatacgtctttcaagtgatgtctttgcttctggaaacacacaaaaatgacatcccgtcttcctatatggccttatttcctcatctccttcagccagtgctttgggaaagaacaggaaatattcctgctctagtgaggcttcttcaagcattcttagaacgcggttcaaacacaatagcaagtgctgcagctgacaaaattcctgggttactaggtgtctttcagaagctgattgcatccaaagcaaatgaccaccaaggtttttatcttctaaacagtataatagagcacatgcctcctgaatcagttgaccaatataggaaacaaatcttcattctgctattccagagacttcagaattccaaaacaaccaagtttatcaagagttttttagtctttattaatttgtattgcataaaatatggggcactagcactacaagaaatatttgatggtatacaaccaaaaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaa

SEQ ID NO: 308101 - DNA, 3156 bp, Homo sapiens
gcattcctggccccgccccctgcagcgggccgctcgctcatgcgctctggcctcaggctcgctgtcgcgccattttgccggggtttgaatgtgaggcggagcggcggcaggagcgggtagtgccagctacggtccgcggctggggttccctcctccgtttctgtatccccacgagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgttgaagatgaaccaaacaaaatttgtgaagccgatcgagtggccattaaagccaacatagtgcacttgatgcttagcagcccagagcaaattcagaagcagttaagtgatgcaattagcattattggcagagaagattttccacagaaatggcctgacttgctgacagaaatggtgaatcgctttcagagtggagatttccatgttattaatggagtcctccgtacagcacattcattatttaaaagataccgtcatgaatttaagtcaaacgagttatggactgaaattaagcttgttctggatgcctttgctttgcctttgactaatctttttaaggccactattgaactctgcagtacccatgcaaatgatgcctctgccctgaggattctgttttcttccctgatcctgatctcaaaattgttctatagtttaaactttcaggatctccctgaattttttgaagataatatggaaacttggatgaataattttcatactctcttaacattggataataagcttttacaaactgatgatgaagaggaagccggcttattggagctcttaaaatcccagatttgtgataatgccgcactctatgcacaaaagtacgatgaagaattccagcgatacctgcctcgttttgttacagccatctggaatttactagttacaacgggtcaagaggttaaatatgatttgttggtaagtaatgcaattcaatttctggcttcagtttgtgagagacctcattataagaatctatttgaggaccagaacacgctgacaagtatctgtgaaaaggttattgtgcctaacatggaatttagagctgctgatgaagaagcatttgaagataattctgaggagtacataaggagagatttggaaggatctgatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaagcccaaacacagaagcatggaattacacaagcaaatgaacttgtaaacctaactgagttctttgtgaatcacatcctccctgatttaaaatcagctaatgtgaatgaatttcctgtccttaaagctgacggtatcaaatatattatgatttttagaaatcaagtgccaaaagaacatcttttagtctcgattcctctcttgattaatcatcttcaagctgaaagtattgttgttcatacttacgcagctcatgctcttgaacggctctttactatgcgagggcctaacaatgccactctctttacagctgcagaaatcgcaccgtttgttgagattctgctaacaaaccttttcaaagctctcacacttcctggctcttcagaaaatgaatatattatgaaagctatcatgagaagtttttctctcctacaagaagccataatcccctacatccctactctcatcactcagcttacacagaagctattagctgttagtaagaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatgatgtgcaagaatttattccatacgtctttcaagtgatgtctttgcttctggaaacacacaaaaatgacatcccgtcttcctatatggccttatttcctcatctccttcagccagtgctttgggaaagaacaggaaatattcctgctctagtgaggcttcttcaagcattcttagaacgcggttcaaacacaatagcaagtgctgcagctgacaaaattcctgggttactaggtgtctttcagaagctgattgcatccaaagcaaatgaccaccaaggtttttatcttctaaacagtataatagagcacatgcctcctgaatcagttgaccaatataggaaacaaatcttcattctgctattccagagacttcagaattccaaaacaaccaagtttatcaagagttttttagtctttattaatttgtattgcataaaatatggggcactagcactacaagaaatatttgatggtatacaaccaaaaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaa

SEQ ID NO: 308102 - DNA, 2794 bp, Homo sapiens
  misc_feature (256)..(257): n is a, c, g, or t
  misc_feature (283)..(283): n is a, c, g, or t
  misc_feature (287)..(287): n is a, c, g, or t
  misc_feature (289)..(289): n is a, c, g, or t
aggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatccaaaaaaaaaaaaaaaaaaaaaaaaaaaaaagcggccgctcgaattgnngacgcggccgcgaattcgcggcggcnccgngnctgcgagaagacgacagaaggggcagtacccatgcaaatgatgcctctgccctgaggattctgttttcttccctgatcctgatctcaaaattgttctatagtttaaactttcaggatctccctgaattttttgaagataatatggaaacttggatgaataattttcatactctcttaacattggataataagcttttacaaactgatgatgaagaggaagccggcttattggagctcttaaaatcccagatttgtgataatgccgcactctatgcacaaaagtacgatgaagaattccagcgatacctgcctcgttttgttacagccatctggaatttactagttacaacgggtcaagaggttaaatatgatttgttggtaagtaatgcaattcaatttctggcttcagtttgtgagagacctcattataagaatctatttgaggaccagaacacgctgacaagtatctgtgaaaaggttattgtgcctaacatggaatttagagctgctgatgaagaagcatttgaagataattctgaggagtacataaggagagatttggaaggatctgatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaagcccaaacacagaagcatggaattacacaagcaaatgaacttgtaaacctaactgagttctttgtgaatcacatcctccctgatttaaaatcagctaatgtgaatgaatttcctgtccttaaagctgacggtatcaaatatattatgatttttagaaatcaagtgccaaaagaacatcttttagtctcgattcctctcttgattaatcatcttcaagctgaaagtattgttgttcatacttacgcagctcatgctcttgaacggctctttactatgcgagggcctaacaatgccactctctttacagctgcagaaatcgcaccgtttgttgagattctgctaacaaaccttttcaaagctctcacacttcctggctcttcagaaaatgaatatattatgaaagctatcatgagaagtttttctctcctacaagaagccataatcccctacatccctactctcatcactcagcttacacagaagctattagctgttagtaagaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatgatgtgcaagaatttattccatacgtctttcaagtgatgtctttgcttctggaaacacacaaaaatgacatcccgtcttcctatatggccttatttcctcatctccttcagccagtgctttgggaaagaacaggaaatattcctgctctagtgaggcttcttcaagcattcttagaacgcggttcaaacacaatagcaagtgctgcagctgacaaaattcctgggttactaggtgtctttcagaagctgattgcatccaaagcaaatgaccaccaaggtttttatcttctaaacagtataatagagcacatgcctcctgaatcagttgaccaatataggaaacaaatcttcattctgctattccagagacttcagaattccaaaacaaccaagtttatcaagagttttttagtctttattaatttgtattgcataaaatatggggcactagcactacaagaaatatttgatggtatacaaccaaaaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaa

SEQ ID NO: 308103 - DNA, 2731 bp, Homo sapiens
tttagttgatgggcgagaaagtgctgtgggatgaaagttagatttactgccgatgaatatgatagtgaaatggattttggcgtaggtttggtctagggtgtagcctgagaataggggggccattcaacgcctccgtttctgtatcccacgagatcctatagcaatggaactcagcgatgcaaatctgcaaacactaacagaatatttaaagaaaacacttgatcctgatcctgccatccgacgtccagctgagaaatttcttgaatctgttgaaggaaatcagaattatccactgttgcttttgacattactggagaagtcccaggataatgttatcaaagatctccctgaattttttgaagataatatggaaacttggatgaataattttcatactctcttaacattggataataagcttttacaaactgatgatgaagaggaagccggcttattggagctcttaaaatcccagatttgtgataatgccgcactctatgcacaaaagtacgatgaagaattccagcgatacctgcctcgttttgttacagccatctggaatttactagttacaacgggtcaagaggttaaatatgatttgttggtaagtaatgcaattcaatttctggcttcagtttgtgagagacctcattataagaatctatttgaggaccagaacacgctgacaagtatctgtgaaaaggttattgtgcctaacatggaatttagagctgctgatgaagaagcatttgaagataattctgaggagtacataaggagagatttggaaggatctgatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaagcccaaacacagaagcatggaattacacaagcaaatgaacttgtaaacctaactgagttctttgtgaatcacatcctccctgatttaaaatcagctaatgtgaatgaatttcctgtccttaaagctgacggtatcaaatatattatgatttttagaaatcaagtgccaaaagaacatcttttagtctcgattcctctcttgattaatcatcttcaagctgaaagtattgttgttcatacttacgcagctcatgctcttgaacggctctttactatgcgagggcctaacaatgccactctctttacagctgcagaaatcgcaccgtttgttgagattctgctaacaaaccttttcaaagctctcacacttcctggctcttcagaaaatgaatatattatgaaagctatcatgagaagtttttctctcctacaagaagccataatcccctacatccctactctcatcactcagcttacacagaagctattagctgttagtaagaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatgatgtgcaagaatttattccatacgtctttcaagtgatgtctttgcttctggaaacacacaaaaatgacatcccgtcttcctatatggccttatttcctcatctccttcagccagtgctttgggaaagaacaggaaatattcctgctctagtgaggcttcttcaagcattcttagaacgcggttcaaacacaatagcaagtgctgcagctgacaaaattcctgggttactaggtgtctttcagaagctgattgcatccaaagcaaatgaccaccaaggtttttatcttctaaacagtataatagagcacatgcctcctgaatcagttgaccaatataggaaacaaatcttcattctgctattccagagacttcagaattccaaaacaaccaagtttatcaagagttttttagtctttattaatttgtattgcataaaatatggggcactagcactacaagaaatatttgatggtatacaaccaaaaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaa

SEQ ID NO: 308104 - DNA, 3856 bp, Homo sapiens
gcattcctggccccgccccctgcagcgggccgctcgctcatgcgctctggcctcaggctcgctgtcgcgccattttgccggggtttgaatgtgaggcggagcggcggcaggagcgggtagtgccagctacggtccgcggctggggttccctcctccgtttctgtatccccacgagatcctatagcaatggaactcagcgatgcaaatctgcaaacactaacagaatatttaaagaaaacacttgatcctgatcctgccatccgacgtccagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgttgaagatgaaccaaacaaaatttgtgaagccgatcgagtggccattaaagccaacatagtgcacttgatgcttagcagcccagagcaaattcagaagcagttaagtgatgcaattagcattattggcagagaagattttccacagaaatggcctgacttgctgacagaaatggtgaatcgctttcagagtggagatttccatgttattaatggagtcctccgtacagcacattcattatttaaaagataccgtcatgaatttaagtcaaacgagttatggactgaaattaagcttgttctggatgcctttgctttgcctttgactaatctttttaaggccactattgaactctgcagtacccatgcaaatgatgcctctgccctgaggattctgttttcttccctgatcctgatctcaaaattgttctatagtttaaactttcaggatctccctgaattttttgaagataatatggaaacttggatgaataattttcatactctcttaacattggataataagcttttacaaactgatgatgaagaggaagccggcttattggagctcttaaaatcccagatttgtgataatgccgcactctatgcacaaaagtacgatgaagaattccagcgatacctgcctcgttttgttacagccatctggaatttactagttacaacgggtcaagaggttaaatatgatttgttggtaagtaatgcaattcaatttctggcttcagtttgtgagagacctcattataagaatctatttgaggaccagaacacgctgacaagtatctgtgaaaaggttattgtgcctaacatggaatttagagctgctgatgaagaagcatttgaagataattctgaggagtacataaggagagatttggaaggatctgatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaagcccaaacacagaagcatggaattacacaagcaaatgaacttgtaaacctaactgagttctttgtgaatcacatcctccctgatttaaaatcagctaatgtgaatgaatttcctgtccttaaagctgacggtatcaaatatattatgatttttagaaatcaagtgccaaaagaacatcttttagtctcgattcctctcttgattaatcatcttcaagctgaaagtattgttgttcatacttacgcagctcatgctcttgaacggctctttactatgcgagggcctaacaatgccactctctttacagctgcagaaatcgcaccgtttgttgagattctgctaacaaaccttttcaaagctctcacacttcctggctcttcagaaaatgaatatattatgaaagctatcatgagaagtttttctctcctacaagaagccataatcccctacatccctactctcatcactcagcttacacagaagctattagctgttagtaagaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatgatgtgcaagaatttattccatacgtctttcaagtgatgtctttgcttctggaaacacacaaaaatgacatcccgtcttcctatatggccttatttcctcatctccttcagccagtgctttgggaaagaacaggaaatattcctgctctagtgaggcttcttcaagcattcttagaacgcggttcaaacacaatagcaagtgctgcagctgacaaaattcctgggttactaggtgtctttcagaagctgattgcatccaaagcaaatgaccaccaaggtttttatcttctaaacagtataatagagcacatgcctcctgaatcagttgaccaatataggaaacaaatcttcattctgctattccagagacttcagaattccaaaacaaccaagtttatcaagagttttttagtctttattaatttgtattgcataaaatatggggcactagcactacaagaaatatttgatggtatacaaccaaaaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaaggacctatttttgaaggcataaaagcagttgagtttctggagaatttttggatggtgattaatgacttgactggctgctcttcccagagctgtggcagctctcccgtagaagatggggtttgtattggcgcaccaagatctccaacagccagtgtgtgtttcccatctcttgtaggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaaccttgagcaaattagttggtttgtgtgatcatacagttatgtgggtggcttctagtttgcaacttcaagggacaagtattaatagttcagtgtatggcgttggtttgtgttgagcgtttgcacggtttggataatcttaaattttgacggacactgtggagactttctgttactaaatccttttgttttgaagctgttgctatttgtatttctcttgtcctttatattttttgtctgtttatttacgcttttattggaaatgtgaataagtaaagaattacttgtgttacttgccaagcagtgcacatttcatagtttcaaatctgtaatcagcaataaaaatcctaaaatatgtacctaagaacatcttaagggcaggttttcagtgctctctcatgcttttataaaaatgaagaatttctttaaatttc

SEQ ID NO: 308105 - DNA, 3708 bp, Homo sapiens
gcattcctggccccgccccctgcagcgggccgctcgctcatgcgctctggcctcaggctcgctgtcgcgccattttgccggggtttgaatgtgaggcggagcggcggcaggagcgggtagtgccagctacggtccgcggctggggttccctcctccgtttctgtatccccacgagatcctatagcaatggaactcagcgatgcaaatctgcaaacactaacagaatatttaaagaaaacacttgatcctgatcctgccatccgacgtccagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgttgaagatgaaccaaacaaaatttgtgaagccgatcgagtggccattaaagccaacatagtgcacttgatgcttagcagcccagagcaaattcagaagcagttaagtgatgcaattagcattattggcagagaagattttccacagaaatggcctgacttgctgacagaaatggtgaatcgctttcagagtggagatttccatgttattaatggagtcctccgtacagcacattcattatttaaaagataccgtcatgaatttaagtcaaacgagttatggactgaaattaagcttgttctggatgcctttgctttgcctttgactaatctttttaaggccactattgaactctgcagtacccatgcaaatgatgcctctgccctgaggattctgttttcttccctgatcctgatctcaaaattgttctatagtttaaactttcaggatctccctgaattttttgaagataatatggaaacttggatgaataattttcatactctcttaacattggataataagcttttacaaactgatgatgaagaggaagccggcttattggagctcttaaaatcccagatttgtgataatgccgcactctatgcacaaaagtacgatgaagaattccagcgatacctgcctcgttttgttacagccatctggaatttactagttacaacgggtcaagaggttaaatatgatttgttggtaagtaatgcaattcaatttctggcttcagtttgtgagagacctcattataagaatctatttgaggaccagaacacgctgacaagtatctgtgaaaaggttattgtgcctaacatggaatttagagctgctgatgaagaagcatttgaagataattctgaggagtacataaggagagatttggaaggatctgatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaagcccaaacacagaagcatggaattacacaagcaaatgaacttgtaaacctaactgagttctttgtgaatcacatcctccctgatttaaaatcagctaatgtgaatgaatttcctgtccttaaagctgacggtatcaaatatattatgatttttagaaatcaagtgccaaaagaacatcttttagtctcgattcctctcttgattaatcatcttcaagctgaaagtattgttgttcatacttacgcagctcatgctcttgaacggctctttactatgcgagggcctaacaatgccactctctttacagctgcagaaatcgcaccgtttgttgagattctgctaacaaaccttttcaaagctctcacacttcctggctcttcagaaaatgaatatattatgaaagctatcatgagaagtttttctctcctacaagaagccataatcccctacatccctactctcatcactcagcttacacagaagctattagctgttagtaagaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatgatgtgcaagaatttattccatacgtctttcaagtgatgtctttgcttctggaaacacacaaaaatgacatcccgtcttcctatatggccttatttcctcatctccttcagccagtgctttgggaaagaacaggaaatattcctgctctagtgaggcttcttcaagcattcttagaacgcggttcaaacacaatagcaagtgctgcagctgacaaaattcctgggttactaggtgtctttcagaagctgattgcatccaaagcaaatgaccaccaaggtttttatcttctaaacagtataatagagcacatgcctcctgaatcagttgaccaatataggaaacaaatcttcattctgctattccagagacttcagaattccaaaacaaccaagtttatcaagagttttttagtctttattaatttgtattgcataaaatatggggcactagcactacaagaaatatttgatggtatacaaccaaaaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaaggacctatttttgaaggcataaaagcagttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaaccttgagcaaattagttggtttgtgtgatcatacagttatgtgggtggcttctagtttgcaacttcaagggacaagtattaatagttcagtgtatggcgttggtttgtgttgagcgtttgcacggtttggataatcttaaattttgacggacactgtggagactttctgttactaaatccttttgttttgaagctgttgctatttgtatttctcttgtcctttatattttttgtctgtttatttacgcttttattggaaatgtgaataagtaaagaattacttgtgttacttgccaagcagtgcacatttcatagtttcaaatctgtaatcagcaataaaaatcctaaaatatgtacctaagaacatcttaagggcaggttttcagtgctctctcatgcttttataaaaatgaagaatttctttaaatttc

SEQ ID NO: 308106 - DNA, 3050 bp, Homo sapiens
gcattcctggccccgccccctgcagcgggccgctcgctcatgcgctctggcctcaggctcgctgtcgcgccattttgccggggtttgaatgtgaggcggagcggcggcaggagcgggtagtgccagctacggtccgcggctggggttccctcctccgtttctgtatccccacgagatcctatagcaatggaactcagcgatgcaaatctgcaaacactaacagaatatttaaagaaaacacttgatcctgatcctgccatccgacgtccagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgttgaagatgaaccaaacaaaatttgtgaagccgatcgagtggccattaaagccaacatagtgcacttgatgcttagcagcccagagcaaattcagaagcagttaagtgatgcaattagcattattggcagagaagattttccacagaaatggcctgacttgctgacagaaatggtgaatcgctttcagagtggagatttccatgttattaatggagtcctccgtacagcacattcattatttaaaagataccgtcatgaatttaagtcaaacgagttatggactgaaattaagcttgttctggatgcctttgctttgcctttgactaatctttttaaggccactattgaactctgcagtacccatgcaaatgatgcctctgccctgaggattctgttttcttccctgatcctgatctcaaaattgttctatagtttaaactttcaggatctccctgaattttttgaagataatatggaaacttggatgaataattttcatactctcttaacattggataataagcttttacaaactgatgatgaagaggaagccggcttattggagctcttaaaatcccagatttgtgataatgccgcactctatgcacaaaagtacgatgaagaattccagcgatacctgcctcgttttgttacagccatctggaatttactagttacaacgggtcaagaggttaaatatgatttgttggtaagtaatgcaattcaatttctggcttcagtttgtgagagacctcattataagaatctatttgaggaccagaacacgctgacaagtatctgtgaaaaggttattgtgcctaacatggaatttagagctgctgatgaagaagcatttgaagataattctgaggagtacataaggagagatttggaaggatctgatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaagcccaaacacagaagcatggaattacacaagcaaatgaacttgtaaacctaactgagttctttgtgaatcacatcctccctgatttaaaatcagctaatgtgaatgaatttcctgtccttaaagctgacggtatcaaatatattatgatttttagaaatcaagtgccaaaagaacatcttttagtctcgattcctctcttgattaatcatcttcaagctgaaagtattgttgttcatacttacgcagctcatgctcttgaacggctctttactatgcgagggcctaacaatgccactctaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatgatgtgcaagaatttattccatacgtctttcaagtgatgtctttgcttctggaaacacacaaaaatgacatcccgtcttcctatatggccttatttcctcatctccttcagccagtgctttgggaaagaacaggaaatattcctgctctagtgaggcttcttcaagcattcttagaacgcggttcaaacacaatagcaagtgctgcagctgacaaaattcctgggttactaggtgtctttcagaagctgattgcatccaaagcaaatgaccaccaaggtttttatcttctaaacagtataatagagcacatgcctcctgaatcagttgaccaatataggaaacaaatcttcattctgctattccagagacttcagaattccaaaacaaccaagtttatcaagagttttttagtctttattaatttgtattgcataaaatatggggcactagcactacaagaaatatttgatggtatacaaccaaaaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaa

SEQ ID NO: 308107 - DNA, 3425 bp, Homo sapiens
gcattcctggccccgccccctgcagcgggccgctcgctcatgcgctctggcctcaggctcgctgtcgcgccattttgccggggtttgaatgtgaggcggagcggcggcaggagcgggtagtgccagctacggtccgcggctggggttccctcctccgtttctgtatccccacgagatcctatagcaatggaactcagcgatgcaaatctgcaaacactaacagaatatttaaagaaaacacttgatcctgatcctgccatccgacgtccagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgttgaagatgaaccaaacaaaatttgtgaagccgatcgagtggccattaaagccaacatagtgcacttgatgcttagcagcccagagcaaattcagaagcagttaagtgatgcaattagcattattggcagagaagattttccacagaaatggcctgacttgctgacagaaatggtgaatcgctttcagagtggagatttccatgttattaatggagtcctccgtacagcacattcattatttaaaagataccgtcatgaatttaagtcaaacgagttatggactgaaattaagcttgttctggatgcctttgctttgcctttgactaatctttttaaggccactattgaactctgcagtacccatgcaaatgatgcctctgccctgaggattctgttttcttccctgatcctgatctcaaaattgttctatagtttaaactttcaggatctccctgaattttttgaagataatatggaaacttggatgaataattttcatactctcttaacattggataataagcttttacaaactgatgatgaagaggaagccggcttattggagctcttaaaatcccagatttgtgataatgccgcactctatgcacaaaagtacgatgaagaattccagcgatacctgcctcgttttgttacagccatctggaatttactagttacaacgggtcaagaggttaaatatgatttgttggtaagtaatgcaattcaatttctggcttcagtttgtgagagacctcattataagaatctatttgaggaccagaacacgctgacaagtatctgtgaaaaggttattgtgcctaacatggaatttagagctgctgatgaagaagcatttgaagataattctgaggagtacataaggagagatttggaaggatctgatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaagcccaaacacagaagcatggaattacacaagcaaatgaacttgtaaacctaactgagttctttgtgaatcacatcctccctgatttaaaatcagctaatgtgaatgaatttcctgtccttaaagctgacggtatcaaatatattatgatttttagaaatcaagtgccaaaagaacatcttttagtctcgattcctctcttgattaatcatcttcaagctgaaagtattgttgttcatacttacgcagctcatgctcttgaacggctctttactatgcgagggcctaacaatgccactctctttacagctgcagaaatcgcaccgtttgttgagattctgctaacaaaccttttcaaagctctcacacttcctggctcttcagaaaatgaatatattatgaaagctatcatgagaagtttttctctcctacaagaagccataatcccctacatccctactctcatcactcagcttacacagaagctattagctgttagtaagaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatgatgtgcaagaatttattccatacgtctttcaagtgatgtctttgcttctggaaacacacaaaaatgacatcccgtcttcctatatggccttatttcctcatctccttcagccagtgctttgggaaagaacaggaaatattcctgctctagtgaggcttcttcaagcattcttagaacgcggttcaaacacaatagcaagtgctgcagctgacaaaattcctgggttactaggtgtctttcagaagctgattgcatccaaagcaaatgaccaccaaggtttttatcttctaaacagtataatagagcacatgcctcctgaatcagttgaccaatataggaaacaaatcttcattctgctattccagagacttcagaattccaaaacaaccaagtttatcaagagttttttagtctttattaatttgtattgcataaaatatggggcactagcactacaagaaatatttgatggtatacaaccaaaaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaaggacctatttttgaaggcataaaagcagttgagtttctggagaatttttggatggtgattaatgacttgactggctgctcttcccagagctgtggcagctctcccgtagaagatggggtttgtattggcgcaccaagatctccaacagccagtgtgtgtttcccatctcttgtaggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaa

SEQ ID NO: 308108 - DNA, 3170 bp, Homo sapiens
  misc_feature (3115)..(3115): n is a, c, g, or t
gcattcctggccccgccccctgcagcgggccgctcgctcatgcgctctggcctcaggctcgctgtcgcgccattttgccggggtttgaatgtgaggcggagcggcggcaggagcgggtagtgccagctacggtccgcggctggggttccctcctccgtttctgtatccccacgagatcctatagcaatggaactcagcgatgcaaatctgcaaacactaacagaatatttaaagaaaacacttgatcctgatcctgccatccgacgtccagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgttgaagatgaaccaaacaaaatttgtgaagccgatcgagtggccattaaagccaacatagtgcacttgatgcttagcagcccagagcaaattcagaagcagttaagtgatgcaattagcattattggcagagaagattttccacagaaatggcctgacttgctgacagaaatggtgaatcgctttcagagtggagatttccatgttattaatggagtcctccgtacagcacattcattatttaaaagataccgtcatgaatttaagtcaaacgagttatggactgaaattaagcttgttctggatgcctttgctttgcctttgactaatctttttaaggccactattgaactctgcagtacccatgcaaatgatgcctctgccctgaggattctgttttcttccctgatcctgatctcaaaattgttctatagtttaaactttcaggatctccctgaattttttgaagataatatggaaacttggatgaataattttcatactctcttaacattggataataagcttttacaaactgatgatgaagaggaagccggcttattggagctcttaaaatcccagatttgtgataatgccgcactctatgcacaaaagtacgatgaagaattccagcgatacctgcctcgttttgttacagccatctggaatttactagttacaacgggtcaagaggttaaatatgatttgttggtaagtaatgcaattcaatttctggcttcagtttgtgagagacctcattataagaatctatttgaggaccagaacacgctgacaagtatctgtgaaaaggttattgtgcctaacatggaatttagagctgctgatgaagaagcatttgaagataattctgaggagtacataaggagagatttggaaggatctgatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaagcccaaacacagaagcatggaattacacaagcaaatgaacttgtaaacctaactgagttctttgtgaatcacatcctccctgatttaaaatcagctaatgtgaatgaatttcctgtccttaaagctgacggtatcaaatatattatgatttttagaaatcaagtgccaaaagaacatcttttagtctcgattcctctcttgattaatcatcttcaagctgaaagtattgttgttcatacttacgcagctcatgctcttgaacggctctttactatgcgagggcctaacaatgccactctctttacagctgcagaaatcgcaccgtttgttgagattctgctaacaaaccttttcaaagctctcacacttcctggctcttcagaaaatgaatatattatgaaagctatcatgagaagtttttctctcctacaagaagccataatcccctacatccctactctcatcactcagcttacacagaagctattagctgttagtaagaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatgatgtgcaagaatttattccatacgtctttcaagtgatgtctttgcttctggaaacacacaaaaatgacatcccgtcttcctatatggccttatttcctcatctccttcagccagtgctttgggaaagaacaggaaatattcctgctctagtgaggcttcttcaagcattcttagaacgcggttcaaacacaatagcaagtgctgcagctgacaaaattcctgggttactaggtgtctttcagaagctgattgcatccaaagcaaatgaccaccaaggtttttatcttctaaacagtataatagagcacatgcctcctgaatcagttgaccaatataggaaacaaatcttcattctgctattccagagacttcagaattccaaaacaaccaagtttatcaagagttttttagtctttattaatttgtattgcataaaatatggggcactagcactacaagaaatatttgatggtatacaaccaaaaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggtaagtgtgttgtcaaagaactctgtgataaatggagactttaatgggagggcaaaaggatagtagtagttctggtgtctgttttcattggtggctgaagatngttggtggccccgcaagattgttggtggcccatgaagattgttggggatacgagc

SEQ ID NO: 308109 - DNA, 3170 bp, Homo sapiens
gcattcctggccccgccccctgcagcgggccgctcgctcatgcgctctggcctcaggctcgctgtcgcgccattttgccggggtttgaatgtgaggcggagcggcggcaggagcgggtagtgccagctacggtccgcggctggggttccctcctccgtttctgtatccccacgagatcctatagcaatggaactcagcgatgcaaatctgcaaacactaacagaatatttaaagaaaacacttgatcctgatcctgccatccgacgtccagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgttgaagatgaaccaaacaaaatttgtgaagccgatcgagtggccattaaagccaacatagtgcacttgatgcttagcagcccagagcaaattcagaagcagttaagtgatgcaattagcattattggcagagaagattttccacagaaatggcctgacttgctgacagaaatggtgaatcgctttcagagtggagatttccatgttattaatggagtcctccgtacagcacattcattatttaaaagataccgtcatgaatttaagtcaaacgagttatggactgaaattaagcttgttctggatgcctttgctttgcctttgactaatctttttaaggccactattgaactctgcagtacccatgcaaatgatgcctctgccctgaggattctgttttcttccctgatcctgatctcaaaattgttctatagtttaaactttcaggatctccctgaattttttgaagataatatggaaacttggatgaataattttcatactctcttaacattggataataagcttttacaaactgatgatgaagaggaagccggcttattggagctcttaaaatcccagatttgtgataatgccgcactctatgcacaaaagtacgatgaagaattccagcgatacctgcctcgttttgttacagccatctggaatttactagttacaacgggtcaagaggttaaatatgatttgttggtaagtaatgcaattcaatttctggcttcagtttgtgagagacctcattataagaatctatttgaggaccagaacacgctgacaagtatctgtgaaaaggttattgtgcctaacatggaatttagagctgctgatgaagaagcatttgaagataattctgaggagtacataaggagagatttggaaggatctgatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaagcccaaacacagaagcatggaattacacaagcaaatgaacttgtaaacctaactgagttctttgtgaatcacatcctccctgatttaaaatcagctaatgtgaatgaatttcctgtccttaaagctgacggtatcaaatatattatgatttttagaaatcaagtgccaaaagaacatcttttagtctcgattcctctcttgattaatcatcttcaagctgaaagtattgttgttcatacttacgcagctcatgctcttgaacggctctttactatgcgagggcctaacaatgccactctctttacagctgcagaaatcgcaccgtttgttgagattctgctaacaaaccttttcaaagctctcacacttcctggctcttcagaaaatgaatatattatgaaagctatcatgagaagtttttctctcctacaagaagccataatcccctacatccctactctcatcactcagcttacacagaagctattagctgttagtaagaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatgatgtgcaagaatttattccatacgtctttcaagtgatgtctttgcttctggaaacacacaaaaatgacatcccgtcttcctatatggccttatttcctcatctccttcagccagtgctttgggaaagaacaggaaatattcctgctctagtgaggcttcttcaagcattcttagaacgcggttcaaacacaatagcaagtgctgcagctgacaaaattcctgggttactaggtgtctttcagaagctgattgcatccaaagcaaatgaccaccaaggtttttatcttctaaacagtataatagagcacatgcctcctgaatcagttgaccaatataggaaacaaatcttcattctgctattccagagacttcagaattccaaaacaaccaagtttatcaagaaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaa

SEQ ID NO: 308110 - DNA, 1147 bp, Homo sapiens
gagtgttctgaggatccctggcttctacaagagcgtacacagatgatgtgcataatttattccatacgtctttcaagtgatgtctttgcttctggaaacacacaaaaatgacatcccgtcttcctatatggccttatttcctcatctccttcagccagtgctttgggaaagaacaggaaatattcctgctctagtgaggcttcttcaagcattcttagaacgcggttcaaacacaatagcaagtgctgcagctgacaaaattcctgggttactaggtgtctttcagaagctgattgcatccaaagcaaatgaccaccaaggtttttatcttctaaacagtataatagagcacatgcctcctgaatcagttgaccaatataggaaacaaatcttcattctgctattccagagacttcagaattccaaaacaaccaagtttatcaagagttttttagtctttattaatttgtattgcataaaatatggggcactagcactacaagaaatatttgatggtatacaaccaaaaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaa

SEQ ID NO: 308111 - DNA, 2806 bp, Homo sapiens
gcattcctggccccgccccctgcagcgggccgctcgctcatgcgctctggcctcaggctcgctgtcgcgccattttgccggggtttgaatgtgaggcggagcggcggcaggagcgggtagtgccagctacggtccgcggctggggttccctcctccgtttctgtatccccacgagatcctatagcaatggaactcagcgatgcaaatctgcaaacactaacagaatatttaaagaaaacacttgatcctgatcctgccatccgacgtccagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgttgaagatgaaccaaacaaaatttgtgaagccgatcgagtggccattaaagccaacatagtgcacttgatgcttagcagcccagagcaaattcagaagcagttaagtgatgcaattagcattattggcagagaagattttccacagaaatggcctgacttgctgacagaaatggtgaatcgctttcagagtggagatttccatgttattaatggagtcctccgtacagcacattcattatttaaaagataccgtcatgaatttaagtcaaacgagttatggactgaaattaagcttgttctggatgcctttgctttgcctttgactaatctttttaaggccactattgaactctgcagtacccatgcaaatgatgcctctgccctgaggattctgttttcttccctgatcctgatctcaaaattgttctatagtttaaactttcaggatctccctgaattttttgaagataatatggaaacttggatgaataattttcatactctcttaacattggataataagcttttacaaactgatgatgaagaggaagccggcttattggagctcttaaaatcccagatttgtgataatgccgcactctatgcacaaaagtacgatgaagaattccagcgatacctgcctcgttttgttacagccatctggaatttactagttacaacgggtcaagaggttaaatatgatttgttggtaagtaatgcaattcaatttctggcttcagtttgtgagagacctcattataagaatctatttgaggaccagaacacgctgacaagtatctgtgaaaaggttattgtgcctaacatggaatttagagctgctgatgaagaagcatttgaagataattctgaggagtacataaggagagatttggaaggatctgatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaagcccaaacacagaagcatggaattacacaagcaaatgaacttgtaaacctaactgagttctttgtgaatcacatcctccctgatttaaaatcagctaatgtgaatgaatttcctgtccttaaagctgacggtatcaaatatattatgatttttagaaatcaagtgccaaaagaacatcttttagtctcgattcctctcttgattaatcatcttcaagctgaaagtattgttgttcatacttacgcagctcatgctcttgaacggctctttactatgcgagggcctaacaatgccactctctttacagctgcagaaatcgcaccgtttgttgagattctgctaacaaaccttttcaaagctctcacacttcctggctcttcagaaaatgaatatattatgaaagctatcatgagaagtttttctctcctacaagaagccataatcccctacatccctactctcatcactcagcttacacagaagctattagctgttagtaagaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatgatgtgcaagaatttattccatacgtctttcaagtgatgtctttgcttctggaaacacacaaaaatgacatcccgtcttcctatatggccttatttcctcatctccttcagccagtgctttgggaaagaacaggaaatattcctgctctagtgaggcttcttcaagcattcttagaacgcggttcaaacacaatagcaagtgctgcagctgacaaaattcctgggttactaggtgtctttcagaagctgattgcatccaaagcaaatgaccaccaaggtttttatcttctaaacagtataatagagcacatgcctcctgaatcagttgaccaatataggaaacaaatcttcattctgctattccagagacttcagaattccaaaacaaccaagtttatcaagagtaagtaaaatcatctggatgttctacagaagtaatgaaagaaggtagctaaaacccttagactttatggttgcagatacattttttatccgttttaaactttatgcaaaaaatacttggccacgtgtggaggttcatgcctgtaatcgcagcactttgggtggccaagggaggccgatcgcttgagctcaggagttcaagaccagcctgggcaacatggcgaaaccctgtccctacgaaaagtacaacaaaatt

SEQ ID NO: 308112 - DNA, 948 bp, Homo sapiens
  misc_feature (29)..(29): n is a, c, g, or t
agatctagaggaccccacgcgcacgcggncaaacacaatagcaagtgtgcagttgacaaaattcctgggttactaggtgtctttcagaagctgattgcatccaaagcaaatgaccaccaaggtttttatcttctaaacagtataatagagcacatgcctcctgaatcagttgaccaatataggaaacaaatcttcattctgctattccagagacttcagaattccaaaacaaccaagtttatcaagagttttttagtctttattaatttgtattgcataaaatatggggcactagcactacaagaaatatttgatggtatacaaccaaaaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaa

SEQ ID NO: 308113 - DNA, 936 bp, Homo sapiens
cccgcttcagagcagtttctcacaatagcaagtgctgcagctgacaaaattcctgggttactaggtgtctttcagaagctgattgcatccaaagcaaatgaccaccaaggtttttatcttctaaacagtataatagagcacatgcctcctgaatcagttgaccaatataggaaacaaatcttcattctgctattccagagacttcagaattccaaaacaaccaagtttatcaagagttttttagtctttattaatttgtattgcataaaatatggggcactagcactacaagaaatatttgatggtatacaaccaaaaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaa

SEQ ID NO: 308114 - DNA, 686 bp, Homo sapiens
ctactactactaaattcgcggcctgctcgacagcactacaagaaatatttgatggtatacaaccaaaaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaa

SEQ ID NO: 308115 - DNA, 2477 bp, Homo sapiens
gcattcctggccccgccccctgcagcgggccgctcgctcatgcgctctggcctcaggctcgctgtcgcgccattttgccggggtttgaatgtgaggcggagcggcggcaggagcgggtagtgccagctacggtccgcggctggggttccctcctccgtttctgtatccccacgagatcctatagcaatggaactcagcgatgcaaatctgcaaacactaacagaatatttaaagaaaacacttgatcctgatcctgccatccgacgtccagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgttgaagatgaaccaaacaaaatttgtgaagccgatcgagtggccattaaagccaacatagtgcacttgatgcttagcagcccagagcaaattcagaagcagttaagtgatgcaattagcattattggcagagaagattttccacagaaatggcctgacttgctgacagaaatggtgaatcgctttcagagtggagatttccatgttattaatggagtcctccgtacagcacattcattatttaaaagataccgtcatgaatttaagtcaaacgagttatggactgaaattaagcttgttctggatgcctttgctttgcctttgactaatctttttaaggtatggaatgcatcttggtgatatttttaaattaatattttaaattgcttgaatgtttgtatacatgttaagagaatgctttgaaagcttatttgatagataatgtttagagcatttcttttgaaaaatttcaaacctacacagaaatagagatgctatagtgaactcccatctattattacacaaatttaatggttagcaacgttttattttctctgttccctttcttaggaatgttataaaagcaaatcccaagcatcatatcatttcacccaagtattttaaagtatgtgtctctaaaggaagaaatacatatttttatttgactatgtttggagtttaattaattatatatttatacattattttacagtttacaggatactttcctgaatgtgttcttggtgtttgtgaaaatcctataagattaaagaaatatatatatactttttttcttttttcttttttaaagacagggtctcactctcattgcccaggctggagtgcatgagctattacagtgccactgcaatccagcctgggcaacagagcgaggtcccgtttcttaaaaaacatatatgtgtgtggcgtgtgtatatatatgtatatatattttttcattgtattattacggagactttcaaacatatatagaaagagcataatgaagcctgcatgtgcccagcttcaataattaccaatatcttgccagttttgtttcgtttctccttttattctctgtattgagcaagtcttagacatcatacgtttcacgcgtaagtaccttattctacatcattaaccagtaaggactttttaattaaccacaataccactatcacacctaataatagtaattccttatggatcttttctttagacctatttttgaaggcataaaagcagttgagtttctggagaatttttggatggtgattaatgacttgactggctgctcttcccagagctgtggcagctctcccgtagaagatggggtttgtattggcgcaccaagatctccaacagccagtgtgtgtttcccatctcttgtaggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaaccttgagcaaattagttggtttgtgtgatcatacagttatgtgggtggcttctagtttgcaacttcaagggacaagtattaatagttcagtgtatggcgttggtttgtgttgagcgtttgcacggtttggataatcttaaattttgacggacactgtggagactttctgttactaaatccttttgttttgaagctgttgctatttgtatttctcttgtcctttatattttttgtctgtttatttacgcttttattggaaatgtgaataagtaaagaattacttgtgttacttgccaagcagtgcacatttcatagtttcaaatctgtaatcagcaataaaaatcctaaaatatgtacctaagaacatcttaagggcaggttttcagtgctctctcatgcttttataaaaatgaagaatttctttaaatttc

SEQ ID NO: 308116 - DNA, 2046 bp, Homo sapiens
gcattcctggccccgccccctgcagcgggccgctcgctcatgcgctctggcctcaggctcgctgtcgcgccattttgccggggtttgaatgtgaggcggagcggcggcaggagcgggtagtgccagctacggtccgcggctggggttccctcctccgtttctgtatccccacgagatcctatagcaatggaactcagcgatgcaaatctgcaaacactaacagaatatttaaagaaaacacttgatcctgatcctgccatccgacgtccagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgttgaagatgaaccaaacaaaatttgtgaagccgatcgagtggccattaaagccaacatagtgcacttgatgcttagcagcccagagcaaattcagaagcagttaagtgatgcaattagcattattggcagagaagattttccacagaaatggcctgacttgctgacagaaatggtgaatcgctttcagagtggagatttccatgttattaatggagtcctccgtacagcacattcattatttaaaagataccgtcatgaatttaagtcaaacgagttatggactgaaattaagcttgttctggatgcctttgctttgcctttgactaatctttttaaggtatggaatgcatcttggtgatatttttaaattaatattttaaattgcttgaatgtttgtatacatgttaagagaatgctttgaaagcttatttgatagataatgtttagagcatttcttttgaaaaatttcaaacctacacagaaatagagatgctatagtgaactcccatctattattacacaaatttaatggttagcaacgttttattttctctgttccctttcttaggaatgttataaaagcaaatcccaagcatcatatcatttcacccaagtattttaaagtatgtgtctctaaaggaagaaatacatatttttatttgactatgtttggagtttaattaattatatatttatacattattttacagtttacaggatactttcctgaatgtgttcttggtgtttgtgaaaatcctataagattaaagaaatatatatatactttttttcttttttcttttttaaagacagggtctcactctcattgcccaggctggagtgcatgagctattacagtgccactgcaatccagcctgggcaacagagcgaggtcccgtttcttaaaaaacatatatgtgtgtggcgtgtgtatatatatgtatatatattttttcattgtattattacggagactttcaaacatatatagaaagagcataatgaagcctgcatgtgcccagcttcaataattaccaatatcttgccagttttgtttcgtttctccttttattctctgtattgagcaagtcttagacatcatacgtttcacgcgtaagtaccttattctacatcattaaccagtaaggactttttaattaaccacaataccactatcacacctaataatagtaattccttatggatcttttctttagacctatttttgaaggcataaaagcagttgagtttctggagaatttttggatggtgattaatgacttgactggctgctcttcccagagctgtggcagctctcccgtagaagatggggtttgtattggcgcaccaagatctccaacagccagtgtgtgtttcccatctcttgtaggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaa

SEQ ID NO: 308117 - DNA, 835 bp, Homo sapiens
ctccggtcgttctagaggatcctaataatggagtcacagtttggtatactcagtgtcaccattgggcacattctgttagtaattggttatgccaaccggagagtcacttcacaagttgtctaccgcctgtccaggaaggacctatttttgaaggcataaaagcagttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaaccttgagcaaattagttggtttgtgtgatcatacagttatgtgggtggcttctagtttgcaacttcaagggacaagtattaatagttcagtgtatggcgttggtttgtgttgagcgtttgcacggtttggataatcttaaattttgacggacactgtggagactttctgttactaaatccttttgttttgaagctgttgctatttgtatttctcttgtcctttatattttttgtctgtttatttacgcttttattggaaatgtgaataagtaaagaattacttgtgttacttgccaagcagtgcacatttcatagtttcaaatctgtaatcagcaataaaaatcctaaaatatgtacctaagaacatcttaagggcaggttttcagtgctctctcatgcttttataaaaatgaagaatttctttaaatttc

SEQ ID NO: 308118 - DNA, 654 bp, Homo sapiens
gcattcctggccccgccccctgcagcgggccgctcgctcatgcgctctggcctcaggctcgctgtcgcgccattttgccggggtttgaatgtgaggcggagcggcggcaggagcgggtagtgccagctacggtccgcggctggggttccctcctccgtttctgtatccccacgagatcctatagcaatggaactcagcgatgcaaatctgcaaacactaacagaatatttaaagaaaacacttgatcctgatcctgccatccgacgtccagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaa

SEQ ID NO: 308119 - DNA, 653 bp, Homo sapiens
tttagttgatgggcgagaaagtgctgtgggatgaaagttagatttactgccgatgaatatgatagtgaaatggattttggcgtaggtttggtctagggtgtagcctgagaataggggggccattcaacgcctccgtttctgtatcccacgagatcctatagcaatggaactcagcgatgcaaatctgcaaacactaacagaatatttaaagaaaacacttgatcctgatcctgccatccgacgtccaggtaaagaaaataaacgttttttggttgattaattccttcaggacaggtgagagaaacctatgtattatctgcctccttataaatatatttaaaaaaattcatacttgggttctcaagcgtagtttataagtgttacagctgctataccatggtgtgttgtttcttttttgagtaaaatagcttttatttggcatcttctgggattaaaaagtactagttttcggataaaaagtactgacatgtttagaatgctttgtctttgaccttttccaaaatacccacttaaaacatgcctgctttaggccggatgcggtggctcacacctgtaatcccagcactttgggaggctgaggcaggagaattgcttgaatccaggaagcggaggttgcagttaaccgaggccac

SEQ ID NO: 308120 - DNA, 345 bp, Homo sapiens
gagttacagcaagcttattttctttaattaaaaacactgagccctttttttcttgtattatgtactacaaatatattttaagtgaatggatttaggagtgagaacaaaggaggaaaaatcccttcaatagaaatgtaataaggctgtatagttgcattttgtcagcactttataataagagtttatttcccagatcgaagtaatccatctattattaaaatgtggtagcatttttttatttttatttttatttatttatttttttagacagggtctcactcttatccaggctggaatgcagtagtacgattatggctcactgcagcctcaacctcccaggttcaa

SEQ ID NO: 308121 - DNA, 757 bp, Homo sapiens
taaactcatagtggtagggaaagcattccccaaaaggaaattgggttgttttagctagaataggagatgaacagcccaaaaggacatgtcccacatcagtgttcagctggatagcagtttgagaagttcttacttaaatgagtactactatttttgcttacaccttttgaattctgagaagtcaggtttaatgaagctcttgagaacttgtctggcagggagaccaaggaaagaggcataatctaccctcaggggacttgtaccctcattaagaaggcagtactatgccacaagaaatcagtaactaaaagacaattagtttatctgccttggtggtcatcttacaataaacgtagttcagaaaagaaaggggatgtattagtatgcactgagcttgagctttgtaaggaaagtcttcatatagtcttagctgaaccttgaaggaagatttagattaggatgagaactagaggtggcatcatttatagcatacaaacagaggcagaagtcagaatgctttatgcagctgccagatgtagctggagcagagaattcttgtcagaataggtaatgctcaggctgtgaagcctgtgtataaaatgttttgtccacgtggtaagggaacttataaaagtggtgttcttaatattttaatcaaaagtttcaagtcagtgtttattctggatctccctgaattttttgaagataatatggaaacttggatgaataattttcatactctcttaacattggataa

SEQ ID NO: 308122 - DNA, 391 bp, Homo sapiens
gctcgctgtcgcgccattttgccggggtttgaatgtgaggcggagcggcggcaggagcgggtagtgccagctacggtccgcggctggggttccctcctccgtttctgtatccccacgaggtgaggcgcggggcgtgcacggcctaccagagtggctcttggggcccagctgaggaagggatgaggcgctcccggtactaacgagcgctagggagtgagaaccgcgcctctgggcgagagcggaatgtgggcccggggttcgggtggtgcgctcaggcaaggtcttcggcttccctagggagcgcttgccgcgcctcgcggcatcctaggtctctggcccaggtgcggcgaccccagggcctgtgagggctgagggcaactgaggcgcggcc

SEQ ID NO: 308123 - DNA, 533 bp, Homo sapiens
gatgaagaggaagccggcttattggagctcttaaaatcccagatttgtgataatgccgcactctatgcacaaaagtacgatgaagaattccagcgatacctgcctcgttttgttacagccatctggaatttactagttacaacgggtcaagaggttaaatatgatttggtaagatgatggtggagacaaataattaaaagacattctctccctatctcctccaagaaataagctgttgagttttgcttttaaaaatattcttgtttttgtgttttgttccagttggtaagtaatgcaattcaatttctggcttcagtttgtgagagacctcattataagaatctatttgaggaccagaacacgctgacaagtatctgtgaaaaggttattgtgcctaacatggaatttagaggtaattatggcaaaagtatattagtataaatctactaagtctgtgtttgttttttgtaacatattcagtctaattcatttattactggataaaacttgtatgtcatttatttcttattttc

SEQ ID NO: 308124 - DNA, 581 bp, Homo sapiens
tttttcagggggattcatggacccctttaagagtctgatctaggtgatctctaagacaattttatgacagaagcccaactaaactgacttatctttaaggggaagaactgaataagccaagaaaagaaccatcttaatttcaaaggtccccttttattcttgagactatgagtctgtaattttgtgtctctgagcaattgctggttttaagtcttccgagtattttcttgacctttttatctcttgctttcttccaatccaggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggtaagtgtgttgtcaaagaactctgtgataaatggagactttaatgggagggcaaaaggatagtagtagttctggtgtctgttttca

SEQ ID NO: 308125 - DNA, 504 bp, Homo sapiens
ctcatttgggggattatcagtaagtagacatagacattgaggcccacagaagttaaggctagtggcattactaggacttagtatttcttctctgcgagggcacgtgggcttaagacaagttacagctctgggatctgaggtttgtataagcaactctgtaactctgaagtatttttttcatggtggactttgggccatttaaaaaaaaattcaaatgaacaagcactagggtataattggtgtttttttcttaattttgatttttaaaaaataagatggcctctattttaaatgtgttttataaaggttaggtgtggattattagcataattaggttttttttttttaatttcagaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatgatgtgca

SEQ ID NO: 308126 - DNA, 311 bp, Homo sapiens
tttttatctggtgtcccctagttcttctacttggggattttgtaaacaggtctgtgtatccttatttattaccacatatgaggttattttgtgtaggttataataatatatcttggttttttatctttccagaaggaaaaaagctaatgtcatacagatctgctttatcccctggctgttttaattggctttctctgaatcatttctgtttctgtcagtgctgctgtggtgtacccgattatatcaatgttacacacttgaattgatatgacatgtggctgatgtttcatgggtgaaatttaactctaggt

SEQ ID NO: 308127 - DNA, 390 bp, Homo sapiens
ttttttttttgagactgggtcttgctctgttgcccaggttagaatgcagtggtgcaattacagttcactgaagcctcaatttctcccacttcagcctcccaagtatctgagacctcaggcacgttgctaccatgcctggctaatcattttattattattattatttatagagatggggttgcatcatgttgcccaggctggtctcaaactcctgggctcaagcaatccaccagcctcagcctccaaaagtgctgggattacaggcgtgagtcactgtgcccagcccctccttgattttgatgaggaattcactgtcatttaaattggttttcccctataggtacagtatttttctgactactttcaattttttaaaatttatctttagtc

SEQ ID NO: 308128 - DNA, 1253 bp, Homo sapiens
ttttttttttttttttttttttaccctggatgatgattaccattgttgctaatagtttttatctaagtaagcctatgcttgatttctttcagaaaccatttcattggatatcattttttctaaggtttcatttctcccaagtttgtttttttcaataggatagtcagttgacaaaatgtttggcattcttatactatttattgtttacatttaaaattaggtgcaaacagctagtttctcaaatgacctcctaattgattttttttctttaagataaaagtattggttgaggcactggtttataagcatttgtggactttgcagccttatctttaaaaaaaaaaaaattaaaactgtggtccttaaatatcctgtctgaactttggattggaaggcacatttccctttgttattggctatgtagattagcttagaatctgtaagcatatagtgtggttaaatatgtatttcaacttttgttatctttgttgattacttgaataccctaaaaccaatggctgggaaaagatcattgccagactatgtcttcctgatggatctttcttcctgatgggtcttaatggttccagtcagtctgtggccagattcaggatgagataacattcaccatgtcctctctgtagggtttctcatgttttgtctttatcacctggtttctggagaagcagctgcagtctgagttatgataccacttgtggtgtatcagttgcttagggtggggaagaagtataggcttgtctgtattcctctgtgccgggagctggagtcaagattggaagtggaacctaagtgtcaagagttgacagtcatgtccttcctactggcaaaactcttctgagcccagtgggcatggtgggagctggtctcataacctttgtgactagagaaaggatctttttcttaaactatgctttatgagtttgtccctggagagctgcttcttgaagtgtcttggcgcttgcttcggaactttcttgagtaaattaagacattcataattgcaaacacaactctaaaaaatttgacagtaatatgatcagctagatcataccaaaagtaggacaacctagtttatagtttttaattgttgaattattagtgtatttcatctcgattaccttgttcctagagaagtttacttcagattatgctaatgtggttatacagagtcacttagatttttggaacaaatcttaaaccttatacagtgactacgttttaattaaaagaga

SEQ ID NO: 308129 - DNA, 498 bp, Homo sapiens
agtcttatttcaatatggtggtagattattattggcctgtgctgaattcttagaatataagggactcatctgataaaattttcttttctggttcaggtttaaacttatttttaaacgtttctacaagcaattctaaatatgcatataaagttgcaaatttttattagttttttttttttttttttttttaccctggatgatgattaccattgttgctaatagtttttatctaagtaagcctatgcttgatttctttcagaaaccatttcattggatatcattttttctaaggtttcatttctcccaagtttgtttttttcaataggatagtcagttgacaaaatgtttggcattcttatactatttattgtttacatttaaaattaggtgcaaacagctagtttctcaaatgacctcctaattgattttttttctttaagataaaagtattggttgaggcactggtttataagcatttgtggactttgcagccttatc

SEQ ID NO: 308130 - DNA, 2252 bp, Homo sapiens
gggggcgcgcgcgcgcgggcccgggagaggctcccgagccaggcggtcttcggtcctcgcagcgcttccagctccccgcgcccctatgtgagggagacggggaggcccgcggcgcgcaggggagggcgaggcatgtgcacgggccggagggtgctgcagccgcccgaggaagaggaggacggcggcgaggaggagagcggggggctcgcggcggcgggccccggccgaggggatgcagtggactgtgtgtgtctggctgtagcagacgcgaggcggcgacgaggcgccggggacccgcgcgaggggcggccgggaggcggcggcggcggccgccagaagtagcagcaggaccggcggcggcgacggcagccctgaaatgcattttcctctccagcggccatgttaaccaggaaaccttcggccgccgctcccgccgcctacccgaccgattggcggcagtaagcacacaatgaatgatcacctgcatgtcggcagccacgctcacggacagatccaggttcaacagttgtttgaggataacagtaacaagcggacagtgctcacgacacaaccaaatgggcttacaacagtgggcaaaacgggcttgccagtggtgccagagcggcagctggacagcattcatagacggcaggggagctccacctctctaaagtccatggaaggcatggggaaggtgaaagccacccccatgacacctgaacaagcaatgaagcaatacatgcaaaaactcacagccttcgaacaccatgagattttcagctaccctgaaatatatttcttgggtctaaatgctaagaagcgccagggcatgacaggtgggcccaacaatggtggctatgatgatgaccagggatcatatgtgcaggtgccccacgatcacgtggcttacaggtatgaggtcctcaaggtcattgggaaggggagctttgggcaggtggtcaaggcctacgatcacaaagtccaccagcacgtggccctaaagatggtgcggaatgagaagcgcttccaccggcaagcagcggaggagatccgaatcctggaacacctgcggaagcaggacaaggataacacaatgaatgtcatccatatgctggagaatttcaccttccgcaaccacatctgcatgacgtttgagctgctgagcatgaacctctatgagctcatcaagaagaataaattccagggcttcagtctgcctttggttcgcaagtttgcccactcgattctgcagtgcttggatgctttgcacaaaaacagaataattcactgtgaccttaagcccgagaacattttgttaaagcagcagggtagaagcggtattaaagtaattgattttggctccagttgttacgagcatcagcgtgtctacacgtacatccagtcgcgtttttaccgggctccagaagtgatccttggggccaggtatggcatgcccattgatatgtggagcctgggctgcattttagcagagctcctgacgggttaccccctcttgcctggggaagatgaaggggaccagctggcctgtatgattgaactgttgggcatgccctcacagaaactgctggatgcatccaaacgagccaaaaattttgtgagctccaagggttatccccgttactgcactgtcacgactctctcagatggctctgtggtcctaaacggaggccgttcccggagggggaaactgaggggcccaccggagagcagagagtgggggaacgcgctgaaggggtgtgatgatccccttttccttgacttcttaaaacagtgtttagagtgggatcctgcagtgcgcatgaccccaggccaggctttgcggcacccctggctgaggaggcggttgccaaagcctcccaccggggagaaaacgtcagtgaaaaggataactgagagcaccggtgctatcacatctatatccaagttacctccaccttctagctcagcttccaaactgaggactaatttggcgcagatgacagatgccaatgggaatattcagcagaggacagtgttgccaaaacttgttagctgagctcacgtcccctgatgctggtaacctgaaagatacgacattgctgagccttactgggttgaaaaggagtagctcagacctgtttttatttgctcaataactctactcatttgtatcttttcagcacttaattttaatgtaagaaagttgttcattttgtttttataaaatacatgaggacaatgctttaagtttt

SEQ ID NO: 308131 - DNA, 2314 bp, Homo sapiens
gggggcgcgcgcgcgcgggcccgggagaggctcccgagccaggcggtcttcggtcctcgcagcgcttccagctccccgcgcccctatgtgagggagacggggaggcccgcggcgcgcaggggagggcgaggcatgtgcacgggccggagggtgctgcagccgcccgaggaagaggaggacggcggcgaggaggagagcggggggctcgcggcggcgggccccggccgaggcggcggcggcggccgccagaagtagcagcaggaccggcggcggcgacggcagccctgaaatgcattttcctctccagcggccatgttaaccaggaaaccttcggccgccgctcccgccgcctacccgaccggccgaggtggggacagcgccgttcgtcagcttcaggcttccccggggctcggtgcaggggccacccggagcggagtggggactggcccgccctcccccatcgccctgccgcctctccgggccagcaacgctgccgccgcagcccacacgattggcggcagtaagcacacaatgaatgatcacctgcatgtcggcagccacgctcacggacagatccaggttcaacagttgtttgaggataacagtaacaagcggacagtgctcacgacacaaccaaatgggcttacaacagtgggcaaaacgggcttgccagtggtgccagagcggcagctggacagcattcatagacggcaggggagctccacctctctaaagtccatggaaggcatggggaaggtgaaagccacccccatgacacctgaacaagcaatgaagcaatacatgcaaaaactcacagccttcgaacaccatgagattttcagctaccctgaaatatatttcttgggtctaaatgctaagaagcgccagggcatgacaggtgggcccaacaatggtggctatgatgatgaccagggatcatatgtgcaggtgccccacgatcacgtggcttacaggtatgaggtcctcaaggtcattgggaaggggagctttgggcaggtggtcaaggcctacgatcacaaagtccaccagcacgtggccctaaagatggtgcggaatgagaagcgcttccaccggcaagcagcggaggagatccgaatcctggaacacctgcggaagcaggacaaggataacacaatgaatgtcatccatatgctggagaatttcaccttccgcaaccacatctgcatgacgtttgagctgctgagcatgaacctctatgagctcatcaagaagaataaattccagggcttcagtctgcctttggttcgcaagtttgcccactcgattctgcagtgcttggatgctttgcacaaaaacagaataattcactgtgaccttaagcccgagaacattttgttaaagcagcagggtagaagcggtattaaagtaattgattttggctccagttgttacgagcatcagcgtgtctacacgtacatccagtcgcgtttttaccgggctccagaagtgatccttggggccaggtatggcatgcccattgatatgtggagcctgggctgcattttagcagagctcctgacgggttaccccctcttgcctggggaagatgaaggggaccagctggcctgtatgattgaactgttgggcatgccctcacagaaactgctggatgcatccaaacgagccaaaaattttgtgagctccaagggttatccccgttactgcactgtcacgactctctcagatggctctgtggtcctaaacggaggccgttcccggagggggaaactgaggggcccaccggagagcagagagtgggggaacgcgctgaaggggtgtgatgatccccttttccttgacttcttaaaacagtgtttagagtgggatcctgcagtgcgcatgaccccaggccaggctttgcggcacccctggctgaggaggcggttgccaaagcctcccaccggggagaaaacgtcagtgaaaaggataactgagagcaccggtgctatcacatctatatccaagttacctccaccttctagctcagcttccaaactgaggactaatttggcgcagatgacagatgccaatgggaatattcagcagaggacagtgttgccaaaacttgttagctgagctcacgtcccctgatgctggtaacctgaaagatacgacattgctgagccttactgggttgaaaaggagtagctcagacctgtttttatttgctcaataactctactcatttgtatcttttcagcacttaattttaatgtaagaaagttgttcattttgtttttataaaatacatgaggacaatgctttaagtttt

SEQ ID NO: 308132 - DNA, 8900 bp, Homo sapiens
  misc_feature (7746)..(7746): n is a, c, g, or t
gggggcgcgcgcgcgcgggcccgggagaggctcccgagccaggcggtcttcggtcctcgcagcgcttccagctccccgcgcccctatgtgagggagacggggaggcccgcggcgcgcaggggagggcgaggcatgtgcacgggccggagggtgctgcagccgcccgaggaagaggaggacggcggcgaggaggagagcggggggctcgcggcggcgggccccggccgaggggatgcagtggactgtgtgtgtctggctgtagcagacgcgaggcggcgacgaggcgccggggacccgcgcgaggggcggccgggaggcggcggcggcggccgccagaagtagcagcaggaccggcggcggcgacggcagccctgaaatgcattttcctctccagcggccatgttaaccaggaaaccttcggccgccgctcccgccgcctacccgaccggccgaggtggggacagcgccgttcgtcagcttcaggcttccccggggctcggtgcaggggccacccggagcggagtggggactggcccgccctcccccatcgccctgccgcctctccgggccagcaacgctgccgccgcagcccacacgattggcggcagtaagcacacaatgaatgatcacctgcatgtcggcagccacgctcacggacagatccaggttcaacagttgtttgaggataacagtaacaagcggacagtgctcacgacacaaccaaatgggcttacaacagtgggcaaaacgggcttgccagtggtgccagagcggcagctggacagcattcatagacggcaggggagctccacctctctaaagtccatggaaggcatggggaaggtgaaagccacccccatgacacctgaacaagcaatgaagcaatacatgcaaaaactcacagccttcgaacaccatgagattttcagctaccctgaaatatatttcttgggtctaaatgctaagaagcgccagggcatgacaggtgggcccaacaatggtggctatgatgatgaccagggatcatatgtgcaggtgccccacgatcacgtggcttacaggtatgaggtcctcaaggtcattgggaaggggagctttgggcaggtggtcaaggcctacgatcacaaagtccaccagcacgtggccctaaagatggtgcggaatgagaagcgcttccaccggcaagcagcggaggagatccgaatcctggaacacctgcggaagcaggacaaggataacacaatgaatgtcatccatatgctggagaatttcaccttccgcaaccacatctgcatgacgtttgagctgctgagcatgaacctctatgagctcatcaagaagaataaattccagggcttcagtctgcctttggttcgcaagtttgcccactcgattctgcagtgcttggatgctttgcacaaaaacagaataattcactgtgaccttaagcccgagaacattttgttaaagcagcagggtagaagcggtattaaagtaattgattttggctccagttgttacgagcatcagcgtgtctacacgtacatccagtcgcgtttttaccgggctccagaagtgatccttggggccaggtatggcatgcccattgatatgtggagcctgggctgcattttagcagagctcctgacgggttaccccctcttgcctggggaagatgaaggggaccagctggcctgtatgattgaactgttgggcatgccctcacagaaactgctggatgcatccaaacgagccaaaaattttgtgagctccaagggttatccccgttactgcactgtcacgactctctcagatggctctgtggtcctaaacggaggccgttcccggagggggaaactgaggggcccaccggagagcagagagtgggggaacgcgctgaaggggtgtgatgatccccttttccttgacttcttaaaacagtgtttagagtgggatcctgcagtgcgcatgaccccaggccaggctttgcggcacccctggctgaggaggcggttgccaaagcctcccaccggggagaaaacgtcagtgaaaaggataactgagagcaccggtgctatcacatctatatccaagttacctccaccttctagctcagcttccaaactgaggactaatttggcgcagatgacagatgccaatgggaatattcagcagaggacagtgttgccaaaacttgttagctgagctcacgtcccctgatgctggtaacctgaaagatacgacattgctgagccttactgggttgaaaaggagtagctcagacctgtttttatttgctcaataactctactcatttgtatcttttcagcacttaattttaatgtaagaaagttgttcattttgtttttataaaatacatgaggacaatgctttaagtttttatactttcagaaactttttgtgttctaaaagtacaatgagccttactgtatttagtgtggcagaataataacatcagtggcaggccactgattacttcatgactgccacgcatttacagattggtgtcaaagacattcactatgtttttatggttcatgttatatcctccccagggtgacagccccttaaggccctccttttccctccatgctccaggtccatgcacaggtgtagcatgtcctgcttccgtttttcataaattaatctgggtgttgggggtagtgggaggagaacggtcagaatcaaagtgacattctaagaaaaactgtaccttagagattttcctctagtgctcaaacaaatacaaaataagatccccaaggtttaaactgcccagttagcattctgacattctaaaagccggcaaagcagcttttagtggataaatgggaatggaaacgtgtgtgttcctccaaattttctagtatgatcggtgagctgttttgtaaagaagcctcatattacagagttgcttttgcacctaaatttagaattgtattccatgaactgttcctcccttttctctgcttttctcctctctgttcctcttttaataccacacgtctgttgcttgcatttagtttgtcttcttccttcagctgtgtatcccagactgttaatacagaaaagagacatttcagctgtgattatgaccattgtttcatattccaattaaaaaaagaacagcagcctagctacttaaggtggggatttccatagttccaaagaagatttagcagattagagtgagttcacacttttcaggtgccactgtaaggttctctcagcctgggaaactatcaactctttctttaaaaagaaagagggttgaaaatcctctggacgaacagaagtcactttggctgttcagtaaggccaatgttaacaacacgtttagaggaggaaaagttcaacctcaagttaaatggtttgacttattcttcgtatcattagaagaaccccagagatagcattcctctattttattttactttcttttggattgcactgattgtttttgtgggaatgacactttatctggcaaagtaactgagagtttggtaaaagaatattttcttctctgaataataattattttcacagtgaaaatttcagtattttatcactaatgtatgagcaatgatctatatcaatttcaaggcacgtgaaaaaaattttttagtatgtgcaatttaatatagaaagatttctgcctgtttggacaataggttttgggtagtacagattaggataagtaagcttatatatgcacagagattattgtattacctgtaaattgatttacaagtacttaaaagcgtggtccccagtgaggccaagaaagtttccggttaagttctttaataataatcctacagtttatcttaagaaaaaaaaaaaggtttgaaaaaaacactttaatttaggcttcgttggttgatggtggaaaaaaatgctcaggaaatatttcagatatttgccaaaaaaccagtaataaggttaccttattaaaatagtgatatttgctttactatttaaggtgtcactgataaattaatttgtacttctgtgtttagaaattatagcttcttttcccttagtcaaattttttagcatattatacacatttctgtgtaatctgtggaagtgcaataatatgttagtaagttacattttaaataatgctcatgtgacaatactcccaatcaatggcttatagaatttaaagatctgtatattagattttggcttaaaggcatgagaagtataagacttggtttggtggctttgtaagaccaccagcctcttaatgatggttagcttctttaggtcattaaatcaataaaaacatataatgctgttttgctcttctaatgctcctcttccatttccagttatcttcacatttacatttaaatatacaaacctgagcctgccattattaatttccctataaaatgacgatacatgtgaacatttataaatggactaatactgcttgtctttcccccaccgcacaaaactggttcttaagatgccagcaatgaatttgagactatctttatttataaatggaaaccggaaacttttataccaaactataataatgtgcagcactgtagggcttttttttttttccctccaaatacagtgaaatttttttattcacaagagctgccacatctcagcatttagtaatagagctgctttaataaaattctagtttgattgtcatgtcaaaaaaagaaaaatgttgcatctttgtgattttaaaacataaattaatgaaggctctgataggctattaggagttggcttggaaacagtttttggtctcacaggttaccattgtttggggatgtctgagctgttttcagatctaggaatagcacagtgttgtcttgtctttggcagtctcatttggctctgtttcttgcaccaccagcatgttcattaccacttaaatatattgctacagcagtggaacaacagagtggtgcaagacactgtagattaacggtagaggagaaattgtgcccttagtgttaacaatgtgccttttgttctgaatgccatgttgtagggcatgcattttttggcctctttaactcttcgaattctagtcagtaagaatggaacccatctctgcaaagatacatctgtcttaaatatctagttacaggccttaatagaaaccataaggcatgactcatcttcaggcactgaaaaaagataaccatcaggtagtgttacacaaggacttcctatatttaaggggttaaagatggtctttgttgtatcttaacatcagactgatttttacattttttttttgttatgctaacactagacaaaaatcaactgtatttgtaaaaatttacctcaaaccatttaattttatagtgtgattaatcccagggcatttggtatgaaccaaagtgcattccttttatatgtgcctggctctagtaaggatggccagggatttttacaatttgggtgcaaggcacttaagccacttttaaacttaatgggtggtttggggtcgtgttaaatgactccatcagaatgttagaaaacactttaggcatcagtagcattgggccatattggaatcctaaagtgtgaattattttaaggagagcattcatttttgtaatttttttcatcaaaaatatttctggtaagcagaagactttttaaaaaaactgatctggtctcggtaaaggttttaatattgcccaacataatgctgtaatagcattaaaaaaagtatttgtgaactctgtttcttaggggcttgtacatctctctgctatggacatacataaaattaattgtaattatactcagctcaactgctacagttctgtctaggcagtggcttgggtttttatcgagcaacaacttagacacgtgactgtaatatgctgcaactgtgtgtactgaaaatatgtgaaaatggttgaatgtggactgtgtatatatgtatgtaaaaatttctgtgagatgctgctgtcgccacttaacattaaatatgttctagtggattttaatcctagtggccagttctatgatactgtatgtattatacagctgatgacaggagtaagactgtttagtgaatatctgttaaattttattgttgtggccagagataatttcagaataaaattttaatgtcctaccttacttctctcccctttctaactataatttaactcctgatctatttctggtattatcctttgtcaattagcctggagagggtttagaatgcaaaatggatagctctatatcagggtcttgagaagttaaaataattcattctactagtttgttcatagcaatactttattagttcaatataagtatgcagattccaagtggaaaaacaaaggttttagtaagtagttcttgcttttcccaggatattctattccttcacctgtcagatttttatgttaacttttttatatatagcctctgctgtgttctttattatgctagagcttcatatcttcttttattttaaccttcacaatgatagttaagctgggggagcagaacctgtcaattattccccaccagtcttcattcttttctctgcacaagttctggtaaattattctaatgtgctctaaccagttccacccaatgttttttaatgcttatgagtttgcagtttttgtacttggtggtctctgtggttcacatttttttgtgttgtagtgtctcctgcctcggttggctcagaaaataaggcctaggaactgcaattagctcatgatttgtcaagttcagttagtaccaagctaagagtttacttacagatgacagcaagcagatgctctagtaattcgtcagacattgcagggatattgtgtagtcagatattaccctcttgtggaaagaactacctcacatcattatttatttcccttctgttaccaacagccaaggaattacttagtgtggctccctgcatcaatactgggatatgcttaaacaagggaatgccataagagttcccaattgcctcgtcatagcctgggccatagatttttgttactgctaatcttgcttcttaaagttcacacccagtgcaaaaaacccaatcagcaaactaaccccaaaatccaatatatttagaaatgtaagtgttaagagatgtgcattatgtacaaaattgaaaattggtgctaaagtggcaatgtcaatttaaaatttcttgtccagatctgactgactgactcaggagattatagttcctactcattctctttccttttatcagatctttcaaaagcgctttttaaaattgatcaatgtgcaattctgtttgagtctctacagtcctatcccttttggaatgaacagctacacaaataaatattcttggaacttcgaagttgtcttcaaactagctctagaaaatgtccctagttgacattagtgttggtctgttagaaggggaaattgatttgactgcttcatgttttgaaaagagcattaagagggatttgaggaaggtatatgtggctttcttttttcttaagtttgaattacacttgatttcctttgggttattaggcagataaacccttgtcattagtaatacttagcactgtccaaaatgaaaaatgactgccagtgtgttgcacatacataagaaaattacatcttactgcgaagtctttggtttgtttccttatttggtttgactttgacttactattttgctatggtcatatccttaatatctgcggtacatttcatatntatatatggggtgggagcataattgccattcccatgtgtctcaaggaagcttaatgaggaaactaatgagttaatattaactcttctgaagaaagctgacattttaggagtattaagtcatctgtcgttaaggagcagcaagaatatattatgattgtatcacatgttccagaagagcattaccccttacatagaaagctccttggagatttcatgatgttggatgaacatcagtttatccttatacatccctatgagctataattatcctcatttgatacttgaggaaactgaagtgacttgctccaaagtgactacaaaaacattgcagtttgaggcttaggttgtaatcaggtaattttggtcttggacagtaagggaaaatccataatacataaaacacaaaagtttagaaagggggggaagttgagctagcaatgggcatttctattatttaagttacatatcagtttccaggaatatttttcaaatgggacaaactaaaaagttgaggactagagcatcgtagtgtctaagtgcacctaataacttaatgcatgtgcacacaccctcagttaatttgtaagagagtgacttctcattgttatttgtggagaggctaattatagtagcttcattctttattttctgtgttcttaaatttttttttacatttgaaagtatgaaaatactatttttgacactttactgatactcagggattaaaagttaaattttactgactgtagcagcaggtaaatctcttaaatttactcaggtttcctatcctttgcctccatatttaagaaaatatagaatgcctgccagggaaatatataaaaataaaaatttcaaatacaattttaaaataccaatttgtaaataaaccaatttacaaactaaaatattgtgtctttccttgctttttatcccaatttatctcccctcctaagtttgaggagttttatatattaaggctatttcttcatttgtaaaaatgaagtatgctatttgcaaagcaaaagcccatgaaaagccccaaatcatttaagtaaagcttactgaattgttttcaattgttttgggagaaatgtaactaattataagcaatttatgtggaccagcagcaaataaatgtatgagtacatttgggc

SEQ ID NO: 308133 - DNA, 8751 bp, Homo sapiens
  misc_feature (7597)..(7597): n is a, c, g, or t
gggggcgcgcgcgcgcgggcccgggagaggctcccgagccaggcggtcttcggtcctcgcagcgcttccagctccccgcgcccctatgtgagggagacggggaggcccgcggcgcgcaggggagggcgaggcatgtgcacgggccggagggtgctgcagccgcccgaggaagaggaggacggcggcgaggaggagagcggggggctcgcggcggcgggccccggccgaggggatgcagtggactgtgtgtgtctggctgtagcagacgcgaggcggcgacgaggcgccggggacccgcgcgaggggcggccgggaggcggcggcggcggccgccagaagtagcagcaggaccggcggcggcgacggcagccctgaaatgcattttcctctccagcggccatgttaaccaggaaaccttcggccgccgctcccgccgcctacccgaccgattggcggcagtaagcacacaatgaatgatcacctgcatgtcggcagccacgctcacggacagatccaggttcaacagttgtttgaggataacagtaacaagcggacagtgctcacgacacaaccaaatgggcttacaacagtgggcaaaacgggcttgccagtggtgccagagcggcagctggacagcattcatagacggcaggggagctccacctctctaaagtccatggaaggcatggggaaggtgaaagccacccccatgacacctgaacaagcaatgaagcaatacatgcaaaaactcacagccttcgaacaccatgagattttcagctaccctgaaatatatttcttgggtctaaatgctaagaagcgccagggcatgacaggtgggcccaacaatggtggctatgatgatgaccagggatcatatgtgcaggtgccccacgatcacgtggcttacaggtatgaggtcctcaaggtcattgggaaggggagctttgggcaggtggtcaaggcctacgatcacaaagtccaccagcacgtggccctaaagatggtgcggaatgagaagcgcttccaccggcaagcagcggaggagatccgaatcctggaacacctgcggaagcaggacaaggataacacaatgaatgtcatccatatgctggagaatttcaccttccgcaaccacatctgcatgacgtttgagctgctgagcatgaacctctatgagctcatcaagaagaataaattccagggcttcagtctgcctttggttcgcaagtttgcccactcgattctgcagtgcttggatgctttgcacaaaaacagaataattcactgtgaccttaagcccgagaacattttgttaaagcagcagggtagaagcggtattaaagtaattgattttggctccagttgttacgagcatcagcgtgtctacacgtacatccagtcgcgtttttaccgggctccagaagtgatccttggggccaggtatggcatgcccattgatatgtggagcctgggctgcattttagcagagctcctgacgggttaccccctcttgcctggggaagatgaaggggaccagctggcctgtatgattgaactgttgggcatgccctcacagaaactgctggatgcatccaaacgagccaaaaattttgtgagctccaagggttatccccgttactgcactgtcacgactctctcagatggctctgtggtcctaaacggaggccgttcccggagggggaaactgaggggcccaccggagagcagagagtgggggaacgcgctgaaggggtgtgatgatccccttttccttgacttcttaaaacagtgtttagagtgggatcctgcagtgcgcatgaccccaggccaggctttgcggcacccctggctgaggaggcggttgccaaagcctcccaccggggagaaaacgtcagtgaaaaggataactgagagcaccggtgctatcacatctatatccaagttacctccaccttctagctcagcttccaaactgaggactaatttggcgcagatgacagatgccaatgggaatattcagcagaggacagtgttgccaaaacttgttagctgagctcacgtcccctgatgctggtaacctgaaagatacgacattgctgagccttactgggttgaaaaggagtagctcagacctgtttttatttgctcaataactctactcatttgtatcttttcagcacttaattttaatgtaagaaagttgttcattttgtttttataaaatacatgaggacaatgctttaagtttttatactttcagaaactttttgtgttctaaaagtacaatgagccttactgtatttagtgtggcagaataataacatcagtggcaggccactgattacttcatgactgccacgcatttacagattggtgtcaaagacattcactatgtttttatggttcatgttatatcctccccagggtgacagccccttaaggccctccttttccctccatgctccaggtccatgcacaggtgtagcatgtcctgcttccgtttttcataaattaatctgggtgttgggggtagtgggaggagaacggtcagaatcaaagtgacattctaagaaaaactgtaccttagagattttcctctagtgctcaaacaaatacaaaataagatccccaaggtttaaactgcccagttagcattctgacattctaaaagccggcaaagcagcttttagtggataaatgggaatggaaacgtgtgtgttcctccaaattttctagtatgatcggtgagctgttttgtaaagaagcctcatattacagagttgcttttgcacctaaatttagaattgtattccatgaactgttcctcccttttctctgcttttctcctctctgttcctcttttaataccacacgtctgttgcttgcatttagtttgtcttcttccttcagctgtgtatcccagactgttaatacagaaaagagacatttcagctgtgattatgaccattgtttcatattccaattaaaaaaagaacagcagcctagctacttaaggtggggatttccatagttccaaagaagatttagcagattagagtgagttcacacttttcaggtgccactgtaaggttctctcagcctgggaaactatcaactctttctttaaaaagaaagagggttgaaaatcctctggacgaacagaagtcactttggctgttcagtaaggccaatgttaacaacacgtttagaggaggaaaagttcaacctcaagttaaatggtttgacttattcttcgtatcattagaagaaccccagagatagcattcctctattttattttactttcttttggattgcactgattgtttttgtgggaatgacactttatctggcaaagtaactgagagtttggtaaaagaatattttcttctctgaataataattattttcacagtgaaaatttcagtattttatcactaatgtatgagcaatgatctatatcaatttcaaggcacgtgaaaaaaattttttagtatgtgcaatttaatatagaaagatttctgcctgtttggacaataggttttgggtagtacagattaggataagtaagcttatatatgcacagagattattgtattacctgtaaattgatttacaagtacttaaaagcgtggtccccagtgaggccaagaaagtttccggttaagttctttaataataatcctacagtttatcttaagaaaaaaaaaaaggtttgaaaaaaacactttaatttaggcttcgttggttgatggtggaaaaaaatgctcaggaaatatttcagatatttgccaaaaaaccagtaataaggttaccttattaaaatagtgatatttgctttactatttaaggtgtcactgataaattaatttgtacttctgtgtttagaaattatagcttcttttcccttagtcaaattttttagcatattatacacatttctgtgtaatctgtggaagtgcaataatatgttagtaagttacattttaaataatgctcatgtgacaatactcccaatcaatggcttatagaatttaaagatctgtatattagattttggcttaaaggcatgagaagtataagacttggtttggtggctttgtaagaccaccagcctcttaatgatggttagcttctttaggtcattaaatcaataaaaacatataatgctgttttgctcttctaatgctcctcttccatttccagttatcttcacatttacatttaaatatacaaacctgagcctgccattattaatttccctataaaatgacgatacatgtgaacatttataaatggactaatactgcttgtctttcccccaccgcacaaaactggttcttaagatgccagcaatgaatttgagactatctttatttataaatggaaaccggaaacttttataccaaactataataatgtgcagcactgtagggcttttttttttttccctccaaatacagtgaaatttttttattcacaagagctgccacatctcagcatttagtaatagagctgctttaataaaattctagtttgattgtcatgtcaaaaaaagaaaaatgttgcatctttgtgattttaaaacataaattaatgaaggctctgataggctattaggagttggcttggaaacagtttttggtctcacaggttaccattgtttggggatgtctgagctgttttcagatctaggaatagcacagtgttgtcttgtctttggcagtctcatttggctctgtttcttgcaccaccagcatgttcattaccacttaaatatattgctacagcagtggaacaacagagtggtgcaagacactgtagattaacggtagaggagaaattgtgcccttagtgttaacaatgtgccttttgttctgaatgccatgttgtagggcatgcattttttggcctctttaactcttcgaattctagtcagtaagaatggaacccatctctgcaaagatacatctgtcttaaatatctagttacaggccttaatagaaaccataaggcatgactcatcttcaggcactgaaaaaagataaccatcaggtagtgttacacaaggacttcctatatttaaggggttaaagatggtctttgttgtatcttaacatcagactgatttttacattttttttttgttatgctaacactagacaaaaatcaactgtatttgtaaaaatttacctcaaaccatttaattttatagtgtgattaatcccagggcatttggtatgaaccaaagtgcattccttttatatgtgcctggctctagtaaggatggccagggatttttacaatttgggtgcaaggcacttaagccacttttaaacttaatgggtggtttggggtcgtgttaaatgactccatcagaatgttagaaaacactttaggcatcagtagcattgggccatattggaatcctaaagtgtgaattattttaaggagagcattcatttttgtaatttttttcatcaaaaatatttctggtaagcagaagactttttaaaaaaactgatctggtctcggtaaaggttttaatattgcccaacataatgctgtaatagcattaaaaaaagtatttgtgaactctgtttcttaggggcttgtacatctctctgctatggacatacataaaattaattgtaattatactcagctcaactgctacagttctgtctaggcagtggcttgggtttttatcgagcaacaacttagacacgtgactgtaatatgctgcaactgtgtgtactgaaaatatgtgaaaatggttgaatgtggactgtgtatatatgtatgtaaaaatttctgtgagatgctgctgtcgccacttaacattaaatatgttctagtggattttaatcctagtggccagttctatgatactgtatgtattatacagctgatgacaggagtaagactgtttagtgaatatctgttaaattttattgttgtggccagagataatttcagaataaaattttaatgtcctaccttacttctctcccctttctaactataatttaactcctgatctatttctggtattatcctttgtcaattagcctggagagggtttagaatgcaaaatggatagctctatatcagggtcttgagaagttaaaataattcattctactagtttgttcatagcaatactttattagttcaatataagtatgcagattccaagtggaaaaacaaaggttttagtaagtagttcttgcttttcccaggatattctattccttcacctgtcagatttttatgttaacttttttatatatagcctctgctgtgttctttattatgctagagcttcatatcttcttttattttaaccttcacaatgatagttaagctgggggagcagaacctgtcaattattccccaccagtcttcattcttttctctgcacaagttctggtaaattattctaatgtgctctaaccagttccacccaatgttttttaatgcttatgagtttgcagtttttgtacttggtggtctctgtggttcacatttttttgtgttgtagtgtctcctgcctcggttggctcagaaaataaggcctaggaactgcaattagctcatgatttgtcaagttcagttagtaccaagctaagagtttacttacagatgacagcaagcagatgctctagtaattcgtcagacattgcagggatattgtgtagtcagatattaccctcttgtggaaagaactacctcacatcattatttatttcccttctgttaccaacagccaaggaattacttagtgtggctccctgcatcaatactgggatatgcttaaacaagggaatgccataagagttcccaattgcctcgtcatagcctgggccatagatttttgttactgctaatcttgcttcttaaagttcacacccagtgcaaaaaacccaatcagcaaactaaccccaaaatccaatatatttagaaatgtaagtgttaagagatgtgcattatgtacaaaattgaaaattggtgctaaagtggcaatgtcaatttaaaatttcttgtccagatctgactgactgactcaggagattatagttcctactcattctctttccttttatcagatctttcaaaagcgctttttaaaattgatcaatgtgcaattctgtttgagtctctacagtcctatcccttttggaatgaacagctacacaaataaatattcttggaacttcgaagttgtcttcaaactagctctagaaaatgtccctagttgacattagtgttggtctgttagaaggggaaattgatttgactgcttcatgttttgaaaagagcattaagagggatttgaggaaggtatatgtggctttcttttttcttaagtttgaattacacttgatttcctttgggttattaggcagataaacccttgtcattagtaatacttagcactgtccaaaatgaaaaatgactgccagtgtgttgcacatacataagaaaattacatcttactgcgaagtctttggtttgtttccttatttggtttgactttgacttactattttgctatggtcatatccttaatatctgcggtacatttcatatntatatatggggtgggagcataattgccattcccatgtgtctcaaggaagcttaatgaggaaactaatgagttaatattaactcttctgaagaaagctgacattttaggagtattaagtcatctgtcgttaaggagcagcaagaatatattatgattgtatcacatgttccagaagagcattaccccttacatagaaagctccttggagatttcatgatgttggatgaacatcagtttatccttatacatccctatgagctataattatcctcatttgatacttgaggaaactgaagtgacttgctccaaagtgactacaaaaacattgcagtttgaggcttaggttgtaatcaggtaattttggtcttggacagtaagggaaaatccataatacataaaacacaaaagtttagaaagggggggaagttgagctagcaatgggcatttctattatttaagttacatatcagtttccaggaatatttttcaaatgggacaaactaaaaagttgaggactagagcatcgtagtgtctaagtgcacctaataacttaatgcatgtgcacacaccctcagttaatttgtaagagagtgacttctcattgttatttgtggagaggctaattatagtagcttcattctttattttctgtgttcttaaatttttttttacatttgaaagtatgaaaatactatttttgacactttactgatactcagggattaaaagttaaattttactgactgtagcagcaggtaaatctcttaaatttactcaggtttcctatcctttgcctccatatttaagaaaatatagaatgcctgccagggaaatatataaaaataaaaatttcaaatacaattttaaaataccaatttgtaaataaaccaatttacaaactaaaatattgtgtctttccttgctttttatcccaatttatctcccctcctaagtttgaggagttttatatattaaggctatttcttcatttgtaaaaatgaagtatgctatttgcaaagcaaaagcccatgaaaagccccaaatcatttaagtaaagcttactgaattgttttcaattgttttgggagaaatgtaactaattataagcaatttatgtggaccagcagcaaataaatgtatgagtacatttgggc

SEQ ID NO: 308134 - DNA, 6156 bp, Homo sapiens
gggggcgcgcgcgcgcgggcccgggagaggctcccgagccaggcggtcttcggtcctcgcagcgcttccagctccccgcgcccctatgtgagggagacggggaggcccgcggcgcgcaggggagggcgaggcatgtgcacgggccggagggtgctgcagccgcccgaggaagaggaggacggcggcgaggaggagagcggggggctcgcggcggcgggccccggccgaggggatgcagtggactgtgtgtgtctggctgtagcagacgcgaggcggcgacgaggcgccggggacccgcgcgaggggcggccgggaggcggcggcggcggccgccagaagtagcagcaggaccggcggcggcgacggcagccctgaaatgcattttcctctccagcggccatgttaaccaggaaaccttcggccgccgctcccgccgcctacccgaccggccgaggtggggacagcgccgttcgtcagcttcaggcttccccggggctcggtgcaggggccacccggagcggagtggggactggcccgccctcccccatcgccctgccgcctctccgggccagcaacgctgccgccgcagcccacacgattggcggcagtaagcacacaatgaatgatcacctgcatgtcggcagccacgctcacggacagatccaggttcaacagttgtttgaggataacagtaacaagcggacagtgctcacgacacaaccaaatgggcttacaacagtgggcaaaacgggcttgccagtggtgccagagcggcagctggacagcattcatagacggcaggggagctccacctctctaaagtccatggaaggcatggggaaggtgaaagccacccccatgacacctgaacaagcaatgaagcaatacatgcaaaaactcacagccttcgaacaccatgagattttcagctaccctgaaatatatttcttgggtctaaatgctaagaagcgccagggcatgacaggtgggcccaacaatggtggctatgatgatgaccagggatcatatgtgcaggtgccccacgatcacgtggcttacaggtatgaggtcctcaaggtcattgggaaggggagctttgggcaggtggtcaaggcctacgatcacaaagtccaccagcacgtggccctaaagatggtgcggaatgagaagcgcttccaccggcaagcagcggaggagatccgaatcctggaacacctgcggaagcaggacaaggataacacaatgaatgtcatccatatgctggagaatttcaccttccgcaaccacatctgcatgacgtttgagctgctgagcatgaacctctatgagctcatcaagaagaataaattccagggcttcagtctgcctttggttcgcaagtttgcccactcgattctgcagtgcttggatgctttgcacaaaaacagaataattcactgtgaccttaagcccgagaacattttgttaaagcagcagggtagaagcggtattaaagtaattgattttggctccagttgttacgagcatcagcgtgtctacacgtacatccagtcgcgtttttaccgggctccagaagtgatccttggggccaggtatggcatgcccattgatatgtggagcctgggctgcattttagcagagctcctgacgggttaccccctcttgcctggggaagatgaaggggaccagctggcctgtatgattgaactgttgggcatgccctcacagaaactgctggatgcatccaaacgagccaaaaattttgtgagctccaagggttatccccgttactgcactgtcacgactctctcagatggctctgtggtcctaaacggaggccgttcccggagggggaaactgaggggcccaccggagagcagagagtgggggaacgcgctgaaggggtgtgatgatccccttttccttgacttcttaaaacagtgtttagagtgggatcctgcagtgcgcatgaccccaggccaggctttgcggcacccctggctgaggaggcggttgccaaagcctcccaccggggagaaaacgtcagtgaaaaggataactgagagcaccggtgctatcacatctatatccaagttacctccaccttctagctcagcttccaaactgaggactaatttggcgcagatgacagatgccaatgggaatattcagcagaggacagtgttgccaaaacttgttagctgagctcacgtcccctgatgctggtaacctgaaagatacgacattgctgagccttactgggttgaaaaggagtagctcagacctgtttttatttgctcaataactctactcatttgtatcttttcagcacttaattttaatgtaagaaagttgttcattttgtttttataaaatacatgaggacaatgctttaagtttttatactttcagaaactttttgtgttctaaaagtacaatgagccttactgtatttagtgtggcagaataataacatcagtggcaggccactgattacttcatgactgccacgcatttacagattggtgtcaaagacattcactatgtttttatggttcatgttatatcctccccagggtgacagccccttaaggccctccttttccctccatgctccaggtccatgcacaggtgtagcatgtcctgcttccgtttttcataaattaatctgggtgttgggggtagtgggaggagaacggtcagaatcaaagtgacattctaagaaaaactgtaccttagagattttcctctagtgctcaaacaaatacaaaataagatccccaaggtttaaactgcccagttagcattctgacattctaaaagccggcaaagcagcttttagtggataaatgggaatggaaacgtgtgtgttcctccaaattttctagtatgatcggtgagctgttttgtaaagaagcctcatattacagagttgcttttgcacctaaatttagaattgtattccatgaactgttcctcccttttctctgcttttctcctctctgttcctcttttaataccacacgtctgttgcttgcatttagtttgtcttcttccttcagctgtgtatcccagactgttaatacagaaaagagacatttcagctgtgattatgaccattgtttcatattccaattaaaaaaagaacagcagcctagctacttaaggtggggatttccatagttccaaagaagatttagcagattagagtgagttcacacttttcaggtgccactgtaaggttctctcagcctgggaaactatcaactctttctttaaaaagaaagagggttgaaaatcctctggacgaacagaagtcactttggctgttcagtaaggccaatgttaacaacacgtttagaggaggaaaagttcaacctcaagttaaatggtttgacttattcttcgtatcattagaagaaccccagagatagcattcctctattttattttactttcttttggattgcactgattgtttttgtgggaatgacactttatctggcaaagtaactgagagtttggtaaaagaatattttcttctctgaataataattattttcacagtgaaaatttcagtattttatcactaatgtatgagcaatgatctatatcaatttcaaggcacgtgaaaaaaattttttagtatgtgcaatttaatatagaaagatttctgcctgtttggacaataggttttgggtagtacagattaggataagtaagcttatatatgcacagagattattgtattacctgtaaattgatttacaagtacttaaaagcgtggtccccagtgaggccaagaaagtttccggttaagttctttaataataatcctacagtttatcttaagaaaaaaaaaaaggtttgaaaaaaacactttaatttaggcttcgttggttgatggtggaaaaaaatgctcaggaaatatttcagatatttgccaaaaaaccagtaataaggttaccttattaaaatagtgatatttgctttactatttaaggtgtcactgataaattaatttgtacttctgtgtttagaaattatagcttcttttcccttagtcaaattttttagcatattatacacatttctgtgtaatctgtggaagtgcaataatatgttagtaagttacattttaaataatgctcatgtgacaatactcccaatcaatggcttatagaatttaaagatctgtatattagattttggcttaaaggcatgagaagtataagacttggtttggtggctttgtaagaccaccagcctcttaatgatggttagcttctttaggtcattaaatcaataaaaacatataatgctgttttgctcttctaatgctcctcttccatttccagttatcttcacatttacatttaaatatacaaacctgagcctgccattattaatttccctataaaatgacgatacatgtgaacatttataaatggactaatactgcttgtctttcccccaccgcacaaaactggttcttaagatgccagcaatgaatttgagactatctttatttataaatggaaaccggaaacttttataccaaactataataatgtgcagcactgtagggcttttttttttttccctccaaatacagtgaaatttttttattcacaagagctgccacatctcagcatttagtaatagagctgctttaataaaattctagtttgattgtcatgtcaaaaaaagaaaaatgttgcatctttgtgattttaaaacataaattaatgaaggctctgataggctattaggagttggcttggaaacagtttttggtctcacaggttaccattgtttggggatgtctgagctgttttcagatctaggaatagcacagtgttgtcttgtctttggcagtctcatttggctctgtttcttgcaccaccagcatgttcattaccacttaaatatattgctacagcagtggaacaacagagtggtgcaagacactgtagattaacggtagaggagaaattgtgcccttagtgttaacaatgtgccttttgttctgaatgccatgttgtagggcatgcattttttggcctctttaactcttcgaattctagtcagtaagaatggaacccatctctgcaaagatacatctgtcttaaatatctagttacaggccttaatagaaaccataaggcatgactcatcttcaggcactgaaaaaagataaccatcaggtagtgttacacaaggacttcctatatttaaggggttaaagatggtctttgttgtatcttaacatcagactgatttttacattttttttttgttatgctaacactagacaaaaatcaactgtatttgtaaaaatttacctcaaaccatttaattttatagtgtgattaatcccagggcatttggtatgaaccaaagtgcattccttttatatgtgcctggctctagtaaggatggccagggatttttacaatttgggtgcaaggcacttaagccacttttaaacttaatgggtggtttggggtcgtgttaaatgactccatcagaatgttagaaaacactttaggcatcagtagcattgggccatattggaatcctaaagtgtgaattattttaaggagagcattcatttttgtaatttttttcatcaaaaatatttctggtaagcagaagactttttaaaaaaactgatctggtctcggtaaaggttttaatattgcccaacataatgctgtaatagcattaaaaaaagtatttgtgaactctgtttcttaggggcttgtacatctctctgctatggacatacataaaattaattgtaattatactcagctcaactgctacagttctgtctaggcagtggcttgggtttttatcgagcaacaacttagacacgtgactgtaatatgctgcaactgtgtgtactgaaaatatgtgaaaatggttgaatgtggactgtgtatatatgtatgtaaaaatttctgtgagatgctgctgtcgccacttaacattaaatatgttctagtggattttaatcctagtggccagttctatgatactgtatgtattatacagctgatgacaggagtaagactgtttagtgaatatctgttaaattttattgttgtggccagagataatttcagaataaaattttaatgtcctacctta

SEQ ID NO: 308135 - DNA, 4702 bp, Homo sapiens
gggggcgcgcgcgcgcgggcccgggagaggctcccgagccaggcggtcttcggtcctcgcagcgcttccagctccccgcgcccctatgtgagggagacggggaggcccgcggcgcgcaggggagggcgaggcatgtgcacgggccggagggtgctgcagccgcccgaggaagaggaggacggcggcgaggaggagagcggggggctcgcggcggcgggccccggccgaggggatgcagtggactgtgtgtgtctggctgtagcagacgcgaggcggcgacgaggcgccggggacccgcgcgaggggcggccgggaggcggcggcggcggccgccagaagtagcagcaggaccggcggcggcgacggcagccctgaaatgcattttcctctccagcggccatgttaaccaggaaaccttcggccgccgctcccgccgcctacccgaccggccgaggtggggacagcgccgttcgtcagcttcaggcttccccggggctcggtgcaggggccacccggagcggagtggggactggcccgccctcccccatcgccctgccgcctctccgggccagcaacgctgccgccgcagcccacacgattggcggcagtaagcacacaatgaatgatcacctgcatgtcggcagccacgctcacggacagatccaggttcaacagttgtttgaggataacagtaacaagcggacagtgctcacgacacaaccaaatgggcttacaacagtgggcaaaacgggcttgccagtggtgccagagcggcagctggacagcattcatagacggcaggggagctccacctctctaaagtccatggaaggcatggggaaggtgaaagccacccccatgacacctgaacaagcaatgaagcaatacatgcaaaaactcacagccttcgaacaccatgagattttcagctaccctgaaatatatttcttgggtctaaatgctaagaagcgccagggcatgacaggtgggcccaacaatggtggctatgatgatgaccagggatcatatgtgcaggtgccccacgatcacgtggcttacaggtatgaggtcctcaaggtcattgggaaggggagctttgggcaggtggtcaaggcctacgatcacaaagtccaccagcacgtggccctaaagatggtgcggaatgagaagcgcttccaccggcaagcagcggaggagatccgaatcctggaacacctgcggaagcaggacaaggataacacaatgaatgtcatccatatgctggagaatttcaccttccgcaaccacatctgcatgacgtttgagctgctgagcatgaacctctatgagctcatcaagaagaataaattccagggcttcagtctgcctttggttcgcaagtttgcccactcgattctgcagtgcttggatgctttgcacaaaaacagaataattcactgtgaccttaagcccgagaacattttgttaaagcagcagggtagaagcggtattaaagtaattgattttggctccagttgttacgagcatcagcgtgtctacacgtacatccagtcgcgtttttaccgggctccagaagtgatccttggggccaggtatggcatgcccattgatatgtggagcctgggctgcattttagcagagctcctgacgggttaccccctcttgcctggggaagatgaaggggaccagctggcctgtatgattgaactgttgggcatgccctcacagaaactgctggatgcatccaaacgagccaaaaattttgtgagctccaagggttatccccgttactgcactgtcacgactctctcagatggctctgtggtcctaaacggaggccgttcccggagggggaaactgaggggcccaccggagagcagagagtgggggaacgcgctgaaggggtgtgatgatccccttttccttgacttcttaaaacagtgtttagagtgggatcctgcagtgcgcatgaccccaggccaggctttgcggcacccctggctgaggaggcggttgccaaagcctcccaccggggagaaaacgtcagtgaaaaggataactgagagcaccggtgctatcacatctatatccaagttacctccaccttctagctcagcttccaaactgaggactaatttggcgcagatgacagatgccaatgggaatattcagcagaggacagtgttgccaaaacttgttagctgagctcacgtcccctgatgctggtaacctgaaagatacgacattgctgagccttactgggttgaaaaggagtagctcagacctgtttttatttgctcaataactctactcatttgtatcttttcagcacttaattttaatgtaagaaagttgttcattttgtttttataaaatacatgaggacaatgctttaagtttttatactttcagaaactttttgtgttctaaaagtacaatgagccttactgtatttagtgtggcagaataataacatcagtggcaggccactgattacttcatgactgccacgcatttacagattggtgtcaaagacattcactatgtttttatggttcatgttatatcctccccagggtgacagccccttaaggccctccttttccctccatgctccaggtccatgcacaggtgtagcatgtcctgcttccgtttttcataaattaatctgggtgttgggggtagtgggaggagaacggtcagaatcaaagtgacattctaagaaaaactgtaccttagagattttcctctagtgctcaaacaaatacaaaataagatccccaaggtttaaactgcccagttagcattctgacattctaaaagccggcaaagcagcttttagtggataaatgggaatggaaacgtgtgtgttcctccaaattttctagtatgatcggtgagctgttttgtaaagaagcctcatattacagagttgcttttgcacctaaatttagaattgtattccatgaactgttcctcccttttctctgcttttctcctctctgttcctcttttaataccacacgtctgttgcttgcatttagtttgtcttcttccttcagctgtgtatcccagactgttaatacagaaaagagacatttcagctgtgattatgaccattgtttcatattccaattaaaaaaagaacagcagcctagctacttaaggtggggatttccatagttccaaagaagatttagcagattagagtgagttcacacttttcaggtgccactgtaaggttctctcagcctgggaaactatcaactctttctttaaaaagaaagagggttgaaaatcctctggacgaacagaagtcactttggctgttcagtaaggccaatgttaacaacacgtttagaggaggaaaagttcaacctcaagttaaatggtttgacttattcttcgtatcattagaagaaccccagagatagcattcctctattttattttactttcttttggattgcactgattgtttttgtgggaatgacactttatctggcaaagtaactgagagtttggtaaaagaatattttcttctctgaataataattattttcacagtgaaaatttcagtattttatcactaatgtatgagcaatgatctatatcaatttcaaggcacgtgaaaaaaattttttagtatgtgcaatttaatatagaaagatttctgcctgtttggacaataggttttgggtagtacagattaggataagtaagcttatatatgcacagagattattgtattacctgtaaattgatttacaagtacttaaaagcgtggtccccagtgaggccaagaaagtttccggttaagttctttaataataatcctacagtttatcttaagaaaaaaaaaaaggtttgaaaaaaacactttaatttaggcttcgttggttgatggtggaaaaaaatgctcaggaaatatttcagatatttgccaaaaaaccagtaataaggttaccttattaaaatagtgatatttgctttactatttaaggtgtcactgataaattaatttgtacttctgtgtttagaaattatagcttcttttcccttagtcaaattttttagcatattatacacatttctgtgtaatctgtggaagtgcaataatatgttagtaagttacattttaaataatgctcatgtgacaatactcccaatcaatggcttatagaatttaaagatctgtatattagattttggcttaaaggcatgagaagtataagacttggtttggtggctttgtaagaccaccagcctcttaatgatggttagcttctttaggtcattaaatcaataaaaacatataatgctgttttgctcttctaatgctcctcttccatttccagttatcttcacatttacatttaaatatacaaacctgagcctgccattattaatttccctataaaatgacgatacatgtgaacatttataaatggactaatactgcttgtctttcccccaccgcacaaaactggttcttaagatgccagcaatgaatttgagactatctttatttataaatggaaaccggaaacttttataccaaactataataatgtgcagcactgtagggcttttttttttttccctccaaatacagtgaaatttttttattcacaagagctgccacatctcagcatttagtaatagagctgctttaataaaattctagtttgattgtcatgtc

SEQ ID NO: 308136 - DNA, 8813 bp, Homo sapiens
  misc_feature (7659)..(7659): n is a, c, g, or t
gggggcgcgcgcgcgcgggcccgggagaggctcccgagccaggcggtcttcggtcctcgcagcgcttccagctccccgcgcccctatgtgagggagacggggaggcccgcggcgcgcaggggagggcgaggcatgtgcacgggccggagggtgctgcagccgcccgaggaagaggaggacggcggcgaggaggagagcggggggctcgcggcggcgggccccggccgaggcggcggcggcggccgccagaagtagcagcaggaccggcggcggcgacggcagccctgaaatgcattttcctctccagcggccatgttaaccaggaaaccttcggccgccgctcccgccgcctacccgaccggccgaggtggggacagcgccgttcgtcagcttcaggcttccccggggctcggtgcaggggccacccggagcggagtggggactggcccgccctcccccatcgccctgccgcctctccgggccagcaacgctgccgccgcagcccacacgattggcggcagtaagcacacaatgaatgatcacctgcatgtcggcagccacgctcacggacagatccaggttcaacagttgtttgaggataacagtaacaagcggacagtgctcacgacacaaccaaatgggcttacaacagtgggcaaaacgggcttgccagtggtgccagagcggcagctggacagcattcatagacggcaggggagctccacctctctaaagtccatggaaggcatggggaaggtgaaagccacccccatgacacctgaacaagcaatgaagcaatacatgcaaaaactcacagccttcgaacaccatgagattttcagctaccctgaaatatatttcttgggtctaaatgctaagaagcgccagggcatgacaggtgggcccaacaatggtggctatgatgatgaccagggatcatatgtgcaggtgccccacgatcacgtggcttacaggtatgaggtcctcaaggtcattgggaaggggagctttgggcaggtggtcaaggcctacgatcacaaagtccaccagcacgtggccctaaagatggtgcggaatgagaagcgcttccaccggcaagcagcggaggagatccgaatcctggaacacctgcggaagcaggacaaggataacacaatgaatgtcatccatatgctggagaatttcaccttccgcaaccacatctgcatgacgtttgagctgctgagcatgaacctctatgagctcatcaagaagaataaattccagggcttcagtctgcctttggttcgcaagtttgcccactcgattctgcagtgcttggatgctttgcacaaaaacagaataattcactgtgaccttaagcccgagaacattttgttaaagcagcagggtagaagcggtattaaagtaattgattttggctccagttgttacgagcatcagcgtgtctacacgtacatccagtcgcgtttttaccgggctccagaagtgatccttggggccaggtatggcatgcccattgatatgtggagcctgggctgcattttagcagagctcctgacgggttaccccctcttgcctggggaagatgaaggggaccagctggcctgtatgattgaactgttgggcatgccctcacagaaactgctggatgcatccaaacgagccaaaaattttgtgagctccaagggttatccccgttactgcactgtcacgactctctcagatggctctgtggtcctaaacggaggccgttcccggagggggaaactgaggggcccaccggagagcagagagtgggggaacgcgctgaaggggtgtgatgatccccttttccttgacttcttaaaacagtgtttagagtgggatcctgcagtgcgcatgaccccaggccaggctttgcggcacccctggctgaggaggcggttgccaaagcctcccaccggggagaaaacgtcagtgaaaaggataactgagagcaccggtgctatcacatctatatccaagttacctccaccttctagctcagcttccaaactgaggactaatttggcgcagatgacagatgccaatgggaatattcagcagaggacagtgttgccaaaacttgttagctgagctcacgtcccctgatgctggtaacctgaaagatacgacattgctgagccttactgggttgaaaaggagtagctcagacctgtttttatttgctcaataactctactcatttgtatcttttcagcacttaattttaatgtaagaaagttgttcattttgtttttataaaatacatgaggacaatgctttaagtttttatactttcagaaactttttgtgttctaaaagtacaatgagccttactgtatttagtgtggcagaataataacatcagtggcaggccactgattacttcatgactgccacgcatttacagattggtgtcaaagacattcactatgtttttatggttcatgttatatcctccccagggtgacagccccttaaggccctccttttccctccatgctccaggtccatgcacaggtgtagcatgtcctgcttccgtttttcataaattaatctgggtgttgggggtagtgggaggagaacggtcagaatcaaagtgacattctaagaaaaactgtaccttagagattttcctctagtgctcaaacaaatacaaaataagatccccaaggtttaaactgcccagttagcattctgacattctaaaagccggcaaagcagcttttagtggataaatgggaatggaaacgtgtgtgttcctccaaattttctagtatgatcggtgagctgttttgtaaagaagcctcatattacagagttgcttttgcacctaaatttagaattgtattccatgaactgttcctcccttttctctgcttttctcctctctgttcctcttttaataccacacgtctgttgcttgcatttagtttgtcttcttccttcagctgtgtatcccagactgttaatacagaaaagagacatttcagctgtgattatgaccattgtttcatattccaattaaaaaaagaacagcagcctagctacttaaggtggggatttccatagttccaaagaagatttagcagattagagtgagttcacacttttcaggtgccactgtaaggttctctcagcctgggaaactatcaactctttctttaaaaagaaagagggttgaaaatcctctggacgaacagaagtcactttggctgttcagtaaggccaatgttaacaacacgtttagaggaggaaaagttcaacctcaagttaaatggtttgacttattcttcgtatcattagaagaaccccagagatagcattcctctattttattttactttcttttggattgcactgattgtttttgtgggaatgacactttatctggcaaagtaactgagagtttggtaaaagaatattttcttctctgaataataattattttcacagtgaaaatttcagtattttatcactaatgtatgagcaatgatctatatcaatttcaaggcacgtgaaaaaaattttttagtatgtgcaatttaatatagaaagatttctgcctgtttggacaataggttttgggtagtacagattaggataagtaagcttatatatgcacagagattattgtattacctgtaaattgatttacaagtacttaaaagcgtggtccccagtgaggccaagaaagtttccggttaagttctttaataataatcctacagtttatcttaagaaaaaaaaaaaggtttgaaaaaaacactttaatttaggcttcgttggttgatggtggaaaaaaatgctcaggaaatatttcagatatttgccaaaaaaccagtaataaggttaccttattaaaatagtgatatttgctttactatttaaggtgtcactgataaattaatttgtacttctgtgtttagaaattatagcttcttttcccttagtcaaattttttagcatattatacacatttctgtgtaatctgtggaagtgcaataatatgttagtaagttacattttaaataatgctcatgtgacaatactcccaatcaatggcttatagaatttaaagatctgtatattagattttggcttaaaggcatgagaagtataagacttggtttggtggctttgtaagaccaccagcctcttaatgatggttagcttctttaggtcattaaatcaataaaaacatataatgctgttttgctcttctaatgctcctcttccatttccagttatcttcacatttacatttaaatatacaaacctgagcctgccattattaatttccctataaaatgacgatacatgtgaacatttataaatggactaatactgcttgtctttcccccaccgcacaaaactggttcttaagatgccagcaatgaatttgagactatctttatttataaatggaaaccggaaacttttataccaaactataataatgtgcagcactgtagggcttttttttttttccctccaaatacagtgaaatttttttattcacaagagctgccacatctcagcatttagtaatagagctgctttaataaaattctagtttgattgtcatgtcaaaaaaagaaaaatgttgcatctttgtgattttaaaacataaattaatgaaggctctgataggctattaggagttggcttggaaacagtttttggtctcacaggttaccattgtttggggatgtctgagctgttttcagatctaggaatagcacagtgttgtcttgtctttggcagtctcatttggctctgtttcttgcaccaccagcatgttcattaccacttaaatatattgctacagcagtggaacaacagagtggtgcaagacactgtagattaacggtagaggagaaattgtgcccttagtgttaacaatgtgccttttgttctgaatgccatgttgtagggcatgcattttttggcctctttaactcttcgaattctagtcagtaagaatggaacccatctctgcaaagatacatctgtcttaaatatctagttacaggccttaatagaaaccataaggcatgactcatcttcaggcactgaaaaaagataaccatcaggtagtgttacacaaggacttcctatatttaaggggttaaagatggtctttgttgtatcttaacatcagactgatttttacattttttttttgttatgctaacactagacaaaaatcaactgtatttgtaaaaatttacctcaaaccatttaattttatagtgtgattaatcccagggcatttggtatgaaccaaagtgcattccttttatatgtgcctggctctagtaaggatggccagggatttttacaatttgggtgcaaggcacttaagccacttttaaacttaatgggtggtttggggtcgtgttaaatgactccatcagaatgttagaaaacactttaggcatcagtagcattgggccatattggaatcctaaagtgtgaattattttaaggagagcattcatttttgtaatttttttcatcaaaaatatttctggtaagcagaagactttttaaaaaaactgatctggtctcggtaaaggttttaatattgcccaacataatgctgtaatagcattaaaaaaagtatttgtgaactctgtttcttaggggcttgtacatctctctgctatggacatacataaaattaattgtaattatactcagctcaactgctacagttctgtctaggcagtggcttgggtttttatcgagcaacaacttagacacgtgactgtaatatgctgcaactgtgtgtactgaaaatatgtgaaaatggttgaatgtggactgtgtatatatgtatgtaaaaatttctgtgagatgctgctgtcgccacttaacattaaatatgttctagtggattttaatcctagtggccagttctatgatactgtatgtattatacagctgatgacaggagtaagactgtttagtgaatatctgttaaattttattgttgtggccagagataatttcagaataaaattttaatgtcctaccttacttctctcccctttctaactataatttaactcctgatctatttctggtattatcctttgtcaattagcctggagagggtttagaatgcaaaatggatagctctatatcagggtcttgagaagttaaaataattcattctactagtttgttcatagcaatactttattagttcaatataagtatgcagattccaagtggaaaaacaaaggttttagtaagtagttcttgcttttcccaggatattctattccttcacctgtcagatttttatgttaacttttttatatatagcctctgctgtgttctttattatgctagagcttcatatcttcttttattttaaccttcacaatgatagttaagctgggggagcagaacctgtcaattattccccaccagtcttcattcttttctctgcacaagttctggtaaattattctaatgtgctctaaccagttccacccaatgttttttaatgcttatgagtttgcagtttttgtacttggtggtctctgtggttcacatttttttgtgttgtagtgtctcctgcctcggttggctcagaaaataaggcctaggaactgcaattagctcatgatttgtcaagttcagttagtaccaagctaagagtttacttacagatgacagcaagcagatgctctagtaattcgtcagacattgcagggatattgtgtagtcagatattaccctcttgtggaaagaactacctcacatcattatttatttcccttctgttaccaacagccaaggaattacttagtgtggctccctgcatcaatactgggatatgcttaaacaagggaatgccataagagttcccaattgcctcgtcatagcctgggccatagatttttgttactgctaatcttgcttcttaaagttcacacccagtgcaaaaaacccaatcagcaaactaaccccaaaatccaatatatttagaaatgtaagtgttaagagatgtgcattatgtacaaaattgaaaattggtgctaaagtggcaatgtcaatttaaaatttcttgtccagatctgactgactgactcaggagattatagttcctactcattctctttccttttatcagatctttcaaaagcgctttttaaaattgatcaatgtgcaattctgtttgagtctctacagtcctatcccttttggaatgaacagctacacaaataaatattcttggaacttcgaagttgtcttcaaactagctctagaaaatgtccctagttgacattagtgttggtctgttagaaggggaaattgatttgactgcttcatgttttgaaaagagcattaagagggatttgaggaaggtatatgtggctttcttttttcttaagtttgaattacacttgatttcctttgggttattaggcagataaacccttgtcattagtaatacttagcactgtccaaaatgaaaaatgactgccagtgtgttgcacatacataagaaaattacatcttactgcgaagtctttggtttgtttccttatttggtttgactttgacttactattttgctatggtcatatccttaatatctgcggtacatttcatatntatatatggggtgggagcataattgccattcccatgtgtctcaaggaagcttaatgaggaaactaatgagttaatattaactcttctgaagaaagctgacattttaggagtattaagtcatctgtcgttaaggagcagcaagaatatattatgattgtatcacatgttccagaagagcattaccccttacatagaaagctccttggagatttcatgatgttggatgaacatcagtttatccttatacatccctatgagctataattatcctcatttgatacttgaggaaactgaagtgacttgctccaaagtgactacaaaaacattgcagtttgaggcttaggttgtaatcaggtaattttggtcttggacagtaagggaaaatccataatacataaaacacaaaagtttagaaagggggggaagttgagctagcaatgggcatttctattatttaagttacatatcagtttccaggaatatttttcaaatgggacaaactaaaaagttgaggactagagcatcgtagtgtctaagtgcacctaataacttaatgcatgtgcacacaccctcagttaatttgtaagagagtgacttctcattgttatttgtggagaggctaattatagtagcttcattctttattttctgtgttcttaaatttttttttacatttgaaagtatgaaaatactatttttgacactttactgatactcagggattaaaagttaaattttactgactgtagcagcaggtaaatctcttaaatttactcaggtttcctatcctttgcctccatatttaagaaaatatagaatgcctgccagggaaatatataaaaataaaaatttcaaatacaattttaaaataccaatttgtaaataaaccaatttacaaactaaaatattgtgtctttccttgctttttatcccaatttatctcccctcctaagtttgaggagttttatatattaaggctatttcttcatttgtaaaaatgaagtatgctatttgcaaagcaaaagcccatgaaaagccccaaatcatttaagtaaagcttactgaattgttttcaattgttttgggagaaatgtaactaattataagcaatttatgtggaccagcagcaaataaatgtatgagtacatttgggc

SEQ ID NO: 308137 - DNA, 4955 bp, Homo sapiens
gggggcgcgcgcgcgcgggcccgggagaggctcccgagccaggcggtcttcggtcctcgcagcgcttccagctccccgcgcccctatgtgagggagacggggaggcccgcggcgcgcaggggagggcgaggcatgtgcacgggccggagggtgctgcagccgcccgaggaagaggaggacggcggcgaggaggagagcggggggctcgcggcggcgggccccggccgaggggatgcagtggactgtgtgtgtctggctgtagcagacgcgaggcggcgacgaggcgccggggacccgcgcgaggggcggccgggaggcggcggcggcggccgccagaagtagcagcaggaccggcggcggcgacggcagccctgaaatgcattttcctctccagcggccatgttaaccaggaaaccttcggccgccgctcccgccgcctacccgaccggccgaggtggggacagcgccgttcgtcagcttcaggcttccccggggctcggtgcaggggccacccggagcggagtggggactggcccgccctcccccatcgccctgccgcctctccgggccagcaacgctgccgccgcagcccacacgattggcggcagtaagcacacaatgaatgatcacctgcatgtcggcagccacgctcacggacagatccaggttcaacagttgtttgaggataacagtaacaagcggacagtgctcacgacacaaccaaatgggcttacaacagtgggcaaaacgggcttgccagtggtgccagagcggcagctggacagcattcatagacggcaggggagctccacctctctaaagtccatggaaggcatggggaaggtgaaagccacccccatgacacctgaacaagcaatgaagcaatacatgcaaaaactcacagccttcgaacaccatgagattttcagctaccctgaaatatatttcttgggtctaaatgctaagaagcgccagggcatgacaggtgggcccaacaatggtggctatgatgatgaccagggatcatatgtgcaggtgccccacgatcacgtggcttacaggtatgaggtcctcaaggtcattgggaaggggagctttgggcaggtggtcaaggcctacgatcacaaagtccaccagcacgtggccctaaagatggtgcggaatgagaagcgcttccaccggcaagcagcggaggagatccgaatcctggaacacctgcggaagcaggacaaggataacacaatgaatgtcatccatatgctggagaatttcaccttccgcaaccacatctgcatgacgtttgagctgctgagcatgaacctctatgagctcatcaagaagaataaattccagggcttcagtctgcctttggttcgcaagtttgcccactcgattctgcagtgcttggatgctttgcacaaaaacagaataattcactgtgaccttaagcccgagaacattttgttaaagcagcagggtagaagcggtattaaagtaattgattttggctccagttgttacgagcatcagcgtgtctacacgtacatccagtcgcgtttttaccgggctccagaagtgatccttggggccaggtatggcatgcccattgatatgtggagcctgggctgcattttagcagagctcctgacgggttaccccctcttgcctggggaagatgaaggggaccagctggcctgtatgattgaactgttgggcatgccctcacagaaactgctggatgcatccaaacgagccaaaaattttgtgagctccaagggttatccccgttactgcactgtcacgactctctcagatggctctgtggtcctaaacggaggccgttcccggagggggaaactgaggggcccaccggagagcagagagtgggggaacgcgctgaaggggtgtgatgatccccttttccttgacttcttaaaacagtgtttagagtgggatcctgcagtgcgcatgaccccaggccaggctttgcggcacccctggctgaggaggcggttgccaaagcctcccaccggggagaaaacgtcagtgaaaaggataactgagagcaccggtgctatcacatctatatccaagttacctccaccttctagctcagcttccaaactgaggactaatttggcgcagatgacagatgccaatgggaatattcagcagaggacagtgttgccaaaacttgttagctgagctcacgtcccctgatgctggtaacctgaaagatacgacattgctgagccttactgggttgaaaaggagtagctcagacctgtttttatttgctcaataactctactcatttgtatcttttcagcacttaattttaatgtaagaaagttgttcattttgtttttataaaatacatgaggacaatgctttaagtttttatactttcagaaactttttgtgttctaaaagtacaatgagccttactgtatttagtgtggcagaataataacatcagtggcaggccactgattacttcatgactgccacgcatttacagattggtgtcaaagacattcactatgtttttatggttcatgttatatcctccccagggtgacagccccttaaggccctccttttccctccatgctccaggtccatgcacaggtgtagcatgtcctgcttccgtttttcataaattaatctgggtgttgggggtagtgggaggagaacggtcagaatcaaagtgacattctaagaaaaactgtaccttagagattttcctctagtgctcaaacaaatacaaaataagatccccaaggtttaaactgcccagttagcattctgacattctaaaagccggcaaagcagcttttagtggataaatgggaatggaaacgtgtgtgttcctccaaattttctagtatgatcggtgagctgttttgtaaagaagcctcatattacagagttgcttttgcacctaaatttagaattgtattccatgaactgttcctcccttttctctgcttttctcctctctgttcctcttttaataccacacgtctgttgcttgcatttagtttgtcttcttccttcagctgtgtatcccagactgttaatacagaaaagagacatttcagctgtgattatgaccattgtttcatattccaattaaaaaaagaacagcagcctagctacttaaggtggggatttccatagttccaaagaagatttagcagattagagtgagttcacacttttcaggtgccactgtaaggttctctcagcctgggaaactatcaactctttctttaaaaagaaagagggttgaaaatcctctggacgaacagaagtcactttggctgttcagtaaggccaatgttaacaacacgtttagaggaggaaaagttcaacctcaagttaaatggtttgacttattcttcgtatcattagaagaaccccagagatagcattcctctattttattttactttcttttggattgcactgattgtttttgtgggaatgacactttatctggcaaagtaactgagagtttggtaaaagaatattttcttctctgaataataattattttcacagtgaaaatttcagtattttatcactaatgtatgagcaatgatctatatcaatttcaaggcacgtgaaaaaaattttttagtatgtgcaatttaatatagaaagatttctgcctgtttggacaataggttttgggtagtacagattaggataagtaagcttatatatgcacagagattattgtattacctgtaaattgatttacaagtacttaaaagcgtggtccccagtgaggccaagaaagtttccggttaagttctttaataataatcctacagtttatcttaagaaaaaaaaaaaggtttgaaaaaaacactttaatttaggcttcgttggttgatggtggaaaaaaatgctcaggaaatatttcagatatttgccaaaaaaccagtaataaggttaccttattaaaatagtgatatttgctttactatttaaggtgtcactgataaattaatttgtacttctgtgtttagaaattatagcttcttttcccttagtcaaattttttagcatattatacacatttctgtgtaatctgtggaagtgcaataatatgttagtaagttacattttaaataatgctcatgtgacaatactcccaatcaatggcttatagaatttaaagatctgtatattagattttggcttaaaggcatgagaagtataagacttggtttggtggctttgtaagaccaccagcctcttaatgatggttagcttctttaggtcattaaatcaataaaaacatataatgctgttttgctcttctaatgctcctcttccatttccagttatcttcacatttacatttaaatatacaaacctgagcctgccattattaatttccctataaaatgacgatacatgtgaacatttataaatggactaatactgcttgtctttcccccaccgcacaaaactggttcttaagatgccagcaatgaatttgagactatctttatttataaatggaaaccggaaacttttataccaaactataataatgtgcagcactgtagggcttttttttttttccctccaaatacagtgaaatttttttattcacaagagctgccacatctcagcatttagtaatagagctgctttaataaaattctagtttgattgtcatgtcaaaaaaagaaaaatgttgcatctttgtgattttaaaacataaattaatgaaggctctgataggctattaggagttggcttggaaacagtttttggtctcacaggttaccattgtttggggatgtctgagctgttttcagatctaggaatagcacagtgttgtcttgtctttggcagtctcatttggctctgttgttccactgctgtagcaatatatttaagtggtaatgaacatgctggtggtgcactcgtgc

SEQ ID NO: 308138 - DNA, 804 bp, Homo sapiens
gggggcgcgcgcgcgcgggcccgggagaggctcccgagccaggcggtcttcggtcctcgcagcgcttccagctccccgcgcccctatgtgagggagacggggaggcccgcggcgcgcaggggagggcgaggcatgtgcacgggccggagggtgctgcagccgcccgaggaagaggaggacggcggcgaggaggagagcggggggctcgcggcggcgggccccggccgaggggatgcagtggactgtgtgtgtctggctgtagcagacgcgaggcggcgacgaggcgccggggacccgcgcgaggggcggccgggaggcggcggcggcggccgccagaagtagcagcaggaccggcggcggcgacggcagccctgaaatgcattttcctctccagcggccatgttaaccaggaaaccttcggccgccgctcccgccgcctacccgaccggccgaggtggggacagcgccgttcgtcagcttcaggcttccccggggctcggtgcaggggccacccggagcggagtggggactggcccgccctcccccatcgccctgccgcctctccgggccagcaacgctgccgccgcagcccacacgggccacacagactgtcagaatgtttgaggaggagctaaaattccagtctttttggactcaattctattaccataatactatacagcatttctaagatgacttcagaaaagtttttaaacgcccaagactattatcacagtggaatatctgctgtttgccattttcttattggaagaaatgaaaactaccaaactggttagactattg

SEQ ID NO: 308139 - DNA, 594 bp, Homo sapiens
tcattcacccgcgccacccggaagccgcggttcctaccaaccgttcttattgctggcggcctgaggagcccatcatggcgacgccccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatatgcaggtggatttgggctgtaacttcttcgttgacacagtggtcccagatacttcacgcatctatgtggccctgggatatggttttttcctggagttgacactggcagaagctctcaagttcattgatcgtaagagctctctcctcacagagctcagcaacagcctcaccaaggactccatgaatatcaaagcccatatccacatgttgctagaggggcttagagaactacaaggcctgcagaatttcccagagaagcctcaccattgacttcttccccccatcctcagacattaaagagcctgaatgcctttga

SEQ ID NO: 308140 - DNA, 673 bp, Homo sapiens
tattgtagttagaaccatctgacacatagcttttattccattggttttttgttatgtctttctttacaagaatttgaagtccatcaggccgggagttttgtttgttgtgtttgctgctatctcccagtgcctaaaattgcctggcatacagtaggcatttaataatctttgaatcagtgaaaaccagatggtggcttggcatttccacataggaatgagccaggtggaaatcatccaggatataagtagatcttgaagtgataaggaagggtcatcataatcatgtggggcccattttgccctttcttgtttcttttctctaggctcagcaacagcctcaccaaggactccatgaatatcaaagcccatatccacatgttgctagaggtgagagcagctcacccccactaccagactctgtgtttagggtggtgacctgaagaaggaagagagcgaaagaagggaaggaccatctttccctctaaactggagtcaagggagggaggtcagagcaagcctgggggcgtaacccagacccagtctttgttcaatctcttctgtcctctttttcaggggcttagagaactacaaggcctgcagaatttcccagagaagcctcaccattgacttcttccccccatcctcagacattaaagagcctgaatgcctttga

SEQ ID NO: 308141 - DNA, 772 bp, Homo sapiens
tcattcacccgcgccacccggaagccgcggttcctaccaaccgttcttattgctggcggcctgaggtaaaggccgcgcttgggtgtccctgggtggtcgggtccccgagttgggaggggcggaaggctgaacctccagcttgagccggacaagccgattcccagcgttgagagggtagagatgaactgtgtgtgaggccaaactggatcggtcaacatggtcttccccctccccactccccaggagcccatcatggcgacgccccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatatgcaggtggatttgggctgtaacttcttcgttgacacagtggtcccagatacttcacgcatctatgtggccctgggatatggttttttcctggagttgacactggcagaagctctcaagttcattgatcgtaagagctctctcctcacagagctcagcaacagcctcaccaaggactccatgaatatcaaagcccatatccacatgttgctagaggggcttagagaactacaaggcctgcagaatttcccagagaagcctcaccattgacttcttccccccatcctcagacattaaagagcctgaatgcctttga

SEQ ID NO: 308142 - DNA, 563 bp, Homo sapiens
aaacttacggctaggtagcgaggctgggtgcgaggagcccatcatggcgacgccccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatatgcaggtggatttgggctgtaacttcttcgttgacacagtggtcccagatacttcacgcatctatgtggccctgggatatggttttttcctggagttgacactggcagaagctctcaagttcattgatcgtaagagctctctcctcacagagctcagcaacagcctcaccaaggactccatgaatatcaaagcccatatccacatgttgctagaggggcttagagaactacaaggcctgcagaatttcccagagaagcctcaccattgacttcttccccccatcctcagacattaaagagcctgaatgcctttga

SEQ ID NO: 308143 - DNA, 747 bp, Homo sapiens
aaacttacggctaggtagcgaggctgggtgcgaggagcccatcatggcgacgccccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatatgcaggtggatttgggctgtaacttcttcgttgacacagtggtcccagatacttcacgcatctatgtggccctgggatatggttttttcctggagttgacactggcagaagctctcaagttcattgatcgtaagagctctctcctcacagagctcagcaacagcctcaccaaggactccatgaatatcaaagcccatatccacatgttgctagaggggcttagagaactacaaggcctgcagaatttcccagagaagcctcaccattgacttcttccccccatcctcagacattaaagagcctgaatgcctttgaaaaaaaaaaaaaaaaaaaaaaaaaaaaaaaaaaaaaaaaaacccgggggcctttagtgggggggggggaaaaaggggttgaaaggggccggggaaaggggttcccggcccattttttggcacaagggggaaacgggggggccccaaaaggggggggggaaaaaatgaaaacgcggggacccgct

SEQ ID NO: 308144 - DNA, 517 bp, Homo sapiens
tcattcacccgcgccacccggaagccgcggttcctaccaaccgttcttattgctggcggcctgaggagcccatcatggcgacgccccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatatgcaggtggatttgggctgtaacttcttcgttgacacagtggtcccagatacttcacgcatctatgtggccctgggatatggttttttcctggagttgacactggcagaagctctcaagttcattgatcgtaagagctctctcctcacagaaggctccagcacccggcctacccagggcctcctgatttcaagccatatcacatttgctaggggctggacctcagcctcgatttccag

SEQ ID NO: 308145 - DNA, 487 bp, Homo sapiens
tattgtagttagaaccatctgacacatagcttttattccattggttttttgttatgtctttctttacaagaatttgaagtccatcaggccgggagttttgtttgttgtgtttgctgctatctcccagtgcctaaaattgcctggcatacagtaggcatttaataatctttgaatcagtgaaaaccagatggtggcttggcatttccacataggaatgagccaggtggaaatcatccaggatataagtagatcttgaagtgataaggaagggtcatcataatcatgtggggcccattttgccctttcttgtttcttttctctaggctcagcaacagcctcaccaaggactccatgaatatcaaagcccatatccacatgttgctagaggggcttagagaactacaaggcctgcagaatttcccagagaagcctcaccattgacttcttccccccatcctcagacattaaagagcctgaatgcctttga

SEQ ID NO: 308146 - DNA, 481 bp, Homo sapiens
tgagtatcttctatgtaccaggcactatgcgaggttttatatcccagtaggatataagctaggtgctggggatgtgacagtgaataaaataggacaaaatccctgccttcccagagcctcaatttggggaagggtggggagcaaaacataaactatgctaaacagtgataaggacttctccccacttcctctaacctctctttcctcagcccagatacttcacgcatctatgtggccctgggatatggttttttcctggagttgacactggcagaagctctcaagttcattgatcgtaagagctctctcctcacagagctcagcaacagcctcaccaaggactccatgaatatcaaagcccatatccacatgttgctagaggggcttagagaactacaaggcctgcagaatttcccagagaagcctcaccattgacttcttccccccatcctcagacattaaagagcctgaatgcctttga

SEQ ID NO: 308147 - DNA, 391 bp, Homo sapiens
tttcaattagggagatagttggtattaggattaggattgttgtgaagtatagtacggatgctacttgtccaatgatggtaaaagggtagcttactggttgtcctccgattcaggttagaatgaggaggtctgcggctaggagtcaataaagtgattggcttagtgggcgaaatattatgctttgttgtttggatatatggaggatggggattattgctaggatgaggatggatagtaatagggcaaggacgcctcctactctgtatgggggatctccgagatcccccatacagtaagtccattccatgaggatagtgtgtaaaaacaccaccatttccaacactcttctccctttacccatggctgcctggaatgatacttaaggactcat

SEQ ID NO: 308148 - DNA, 988 bp, Homo sapiens
tcattcacccgcgccacccggaagccgcggttcctaccaaccgttcttattgctggcggcctgaggtaaaggccgcgcttgggtgtccctgggtggtcgggtccccgagttgggaggggcggaaggctgaacctccagcttgagccggacaagccgattcccagcgttgagagggtagagatgaactgtgtgtgaggccaaactggatcggtcaacatggtcttccccctccccactccccaggagcccatcatggcgacgccccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatatgcaggtggatttgggctgtaacttcttcgttgacacagtggtcccagatacttcacgcatctatgtggccctgggatatggttttttcctggagttgacactggcagaagctctcaagttcattgatcgtaagagctctctcctcacagagctcagcaacagcctcaccaaggactccatgaatatcaaagcccatatccacatgttgctagaggggcttagagaactacaaggcctgcagaatttcccagagaagcctcaccattgacttcttccccccatcctcagacattaaagagcctgaatgcctttgaaaaaaaaacaagcacaaaaaacctcagagcgcacctaatcgtacagggtcgccggaaacaagagggcacccgacacgggcccatggggacataaagaggttacaccggacccaaagcaccctggagccaccggcgcgacaaccatagacagaggacccccaatataagaagagccagaataacaaacagacaggcagggtacaccgggcctactct

SEQ ID NO: 308149 - DNA, 923 bp, Homo sapiens
tcattcacccgcgccacccggaagccgcggttcctaccaaccgttcttattgctggcggcctgaggtaaaggccgcgcttgggtgtccctgggtggtcgggtccccgagttgggaggggcggaaggctgaacctccagcttgagccggacaagccgattcccagcgttgagagggtagagatgaactgtgtgtgaggccaaactggatcggtcaacatggtcttccccctccccactccccaggagcccatcatggcgacgccccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatatgcaggtggatttgggctgtaacttcttcgttgacacagtggtcccagatacttcacgcatctatgtggccctgggatatggttttttcctggagttgacactggcagaagctctcaagttcattgatcgtaagagctctctcctcacagagctcagcaacagcctcaccaaggactccatgaatatcaaagcccatatccacatgttgctagaggggcttagagaactacaaggcctgcagaatttcccagagaagcctcaccattgacttcttccccccatcctcagacattaaagagcctgaatgcctttgattgaacaacaaccctacaataaaataaaaacaatagcactacaaacaaaaacaccggggggccttttgccgggcggcgagaacacacggtgtatcaaacgggccgctgtccataaaggggtcccggacccctttctgtttcacagggggac

SEQ ID NO: 308150 - DNA, 1183 bp, Homo sapiens
tcattcacccgcgccacccggaagccgcggttcctaccaaccgttcttattgctggcggcctgaggtaaaggccgcgcttgggtgtccctgggtggtcgggtccccgagttgggaggggcggaaggctgaacctccagcttgagccggacaagccgattcccagcgttgagagggtagagatgaactgtgtgtgaggccaaactggatcggtcaacatggtcttccccctccccactccccaggagcccatcatggcgacgccccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatatgcaggtggatttgggctgtaacttcttcgttgacacagtggtcccagatacttcacgcatctatgtggccctgggatatggttttttcctggagttgacactggcagaagctctcaagttcattgatcgtaagagctctctcctcacagagctcagcaacagcctcaccaaggactccatgaatatcaaagcccatatccacatgttgctagaggggcttagagaactacaaggcctgcagaatttcccagagaagcctcaccattgacttcttccccccatcctcagacattaaagagcctgaatgcctttgaaaaaaaaagccaagttccaaatccaaaataataaatgaacgtgctgataaacattcttcttatggttccagcccctactttagttattttcctaaattttacatgtgtaccttttcaagaaagagtaagttttttaagtgatcaatatttatgagaactggactttcttcatataattaaaaaaaaaaaaaaaaaccctaaaaacaaaatccacaacgcaccctactcaaactcagataaaatacacatttgttcattaaagctcacctgctttagagaattttttctcttcacacattagcacagtaagccaatgtttgatccatgctgcaaaagctacacaaaacgaaaagccctggtaactccctagggaactcttaaggcaaagcaaaagcaaaaaccttatgctac

SEQ ID NO: 308151 - DNA, 1004 bp, Homo sapiens
tcattcacccgcgccacccggaagccgcggttcctaccaaccgttcttattgctggcggcctgaggtaaaggccgcgcttgggtgtccctgggtggtcgggtccccgagttgggaggggcggaaggctgaacctccagcttgagccggacaagccgattcccagcgttgagagggtagagatgaactgtgtgtgaggccaaactggatcggtcaacatggtcttccccctccccactccccaggagcccatcatggcgacgccccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatatgcaggtggatttgggctgtaacttcttcgttgacacagtggtcccagatacttcacgcatctatgtggccctgggatatggttttttcctggagttgacactggcagaagctctcaagttcattgatcgtaagagctctctcctcacagagctcagcaacagcctcaccaaggactccatgaatatcaaagcccatatccacatgttgctagaggggcttagagaactacaaggcctgcagaatttcccagagaagcctcaccattgacttcttccccccatcctcagacattaaagagcctgaatgcctttgaaaaaaaaaaaaaaaaaccctaaaaacaaaatccacaacgcaccctactcaaactcagataaaatacacatttgttcattaaagctcacctgctttagagaattttttctcttcacacattagcacagtaagccaatgtttgatccatgctgcaaaagctacacaaaacgaaaagccctggtaactccctagggaactcttaaggcaaagcaaaagcaaaaaccttatgctac

SEQ ID NO: 308152 - DNA, 958 bp, Homo sapiens
tcattcacccgcgccacccggaagccgcggttcctaccaaccgttcttattgctggcggcctgaggtaaaggccgcgcttgggtgtccctgggtggtcgggtccccgagttgggaggggcggaaggctgaacctccagcttgagccggacaagccgattcccagcgttgagagggtagagatgaactgtgtgtgaggccaaactggatcggtcaacatggtcttccccctccccactccccaggagcccatcatggcgacgccccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatatgcaggtggatttgggctgtaacttcttcgttgacacagtggtcccagatacttcacgcatctatgtggccctgggatatggttttttcctggagttgacactggcagaagctctcaagttcattgatcgtaagagctctctcctcacagagctcagcaacagcctcaccaaggactccatgaatatcaaagcccatatccacatgttgctagaggtgagagcagctcacccccactaccagactctgtgtttagggtggtgacctgaagaaggaagagagcgaaagaagggaaggaccatctttccctctaaactggagtcaagggagggaggtcagagcaagcctgggggcgtaacccagacccagtctttgttcaatctcttctgtcctctttttcaggggcttagagaactacaaggcctgcagaatttcccagagaagcctcaccattgacttcttccccccatcctcagacattaaagagcctgaatgcctttga

SEQ ID NO: 308153 - DNA, 1208 bp, Homo sapiens
tcattcacccgcgccacccggaagccgcggttcctaccaaccgttcttattgctggcggcctgaggtaaaggccgcgcttgggtgtccctgggtggtcgggtccccgagttgggaggggcggaaggctgaacctccagcttgagccggacaagccgattcccagcgttgagagggtagagatgaactgtgtgtgaggccaaactggatcggtcaacatggtcttccccctccccactccccaggagcccatcatggcgacgccccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatatgcaggtggatttgggctgtaacttcttcgttgacacagtggtcccagatacttcacgcatctatgtggccctgggatatggttttttcctggagttgacactggcagaagctctcaagttcattgatcgtaagagctctctcctcacagatgttgaactcataggttttcataaggctcagcaacagcctcaccaaggactccatgaatatcaaagcccatatccacatgttgctagaggggcttagagaactacaaggcctgcagaatttcccagagaagcctcaccattgacttcttccccccatcctcagacattaaagagcctgaatgcctttgaaaaaaaaagccaagttccaaatccaaaataataaatgaacgtgctgataaacattcttcttatggttccagcccctactttagttattttcctaaattttacatgtgtaccttttcaagaaagagtaagttttttaagtgatcaatatttatgagaactggactttcttcatataattaaaaaaaaaaaaaaaaaccctaaaaacaaaatccacaacgcaccctactcaaactcagataaaatacacatttgttcattaaagctcacctgctttagagaattttttctcttcacacattagcacagtaagccaatgtttgatccatgctgcaaaagctacacaaaacgaaaagccctggtaactccctagggaactcttaaggcaaagcaaaagcaaaaaccttatgctac

SEQ ID NO: 308154 - DNA, 713 bp, Homo sapiens
tcattcacccgcgccacccggaagccgcggttcctaccaaccgttcttattgctggcggcctgaggtaaaggccgcgcttgggtgtccctgggtggtcgggtccccgagttgggaggggcggaaggctgaacctccagcttgagccggacaagccgattcccagcgttgagagggtagagatgaactgtgtgtgaggccaaactggatcggtcaacatggtcttccccctccccactccccaggagcccatcatggcgacgccccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatatgcaggtggatttgggctgtaacttcttcgttgacacagtggttggcagaagctctcaagttcattgatcgtaagagctctctcctcacagagctcagcaacagcctcaccaaggactccatgaatatcaaagcccatatccacatgttgctagaggggcttagagaactacaaggcctgcagaatttcccagagaagcctcaccattgacttcttccccccatcctcagacattaaagagcctgaatgcctttga

SEQ ID NO: 308155 - DNA, 898 bp, Homo sapiens
tattgtagttagaaccatctgacacatagcttttattccattggttttttgttatgtctttctttacaagaatttgaagtccatcaggccgggagttttgtttgttgtgtttgctgctatctcccagtgcctaaaattgcctggcatacagtaggcatttaataatctttgaatcagtgaaaaccagatggtggcttggcatttccacataggaatgagccaggtggaaatcatccaggatataagtagatcttgaagtgataaggaagggtcatcataatcatgtggggcccattttgccctttcttgtttcttttctctaggctcagcaacagcctcaccaaggactccatgaatatcaaagcccatatccacatgttgctagaggggcttagagaactacaaggcctgcagaatttcccagagaagcctcaccattgacttcttccccccatcctcagacattaaagagcctgaatgcctttgaaaaaaaaagccaagttccaaatccaaaataataaatgaacgtgctgataaacattcttcttatggttccagcccctactttagttattttcctaaattttacatgtgtaccttttcaagaaagagtaagttttttaagtgatcaatatttatgagaactggactttcttcatataattaaaaaaaaaaaaaaaaaccctaaaaacaaaatccacaacgcaccctactcaaactcagataaaatacacatttgttcattaaagctcacctgctttagagaattttttctcttcacacattagcacagtaagccaatgtttgatccatgctgcaaaagctacacaaaacgaaaagccctggtaactccctagggaactcttaaggcaaagcaaaagcaaaaaccttatgctac

SEQ ID NO: 308156 - DNA, 1492 bp, Homo sapiens
ccacaacaaagttcagagatccagctaatattcaaagtagggtcaacctgaactaggaccttcaaggcatcatcacagcaaactgctcagatctccaccccagatggaaggcccagaccatggcaaggcactcttctcgacccctgcaggtattcttaaaaggattctacagacactttttgagcacctcactggaacagactctgggctcaggctgagaacagagacagccagccccagcccccacctcaagctggagacagggtatgaatggagctgtgcctgagctgaagcttctctgtggggcagacgtcttgaagaccttccagacccccaacctctggaaggatgcgcacatccaggaaatagtggagaagtttggcttggtgtgcgtgggccgagtaggtcacgacccaaaaggttacatcgcagaatctcccatcctacggatgcaccagcacaacattcacctggccaaggagcctgtgcagaatgagatcagtgccacatacatcaggcgagccttgggccaagggcagagcgtaaagtacctgattcccgatgctgtcatcacgtacatcaaggaccatggcctctacaccaagggcagtacctggaaaggcaaaagcacccagagcactgagggcaagacaagctagggaggggggactcagcacccacacctcctccaacaagctcctgctggggagagggctgttaaggtttctgttttactttggtttttgcttctccatttttcatttgctttatttctacagtgattctacttctgaggagtcttctgtcccaggaagagataccttctttacaggagaggaaaggtctaaatcacaaggatagacatttatcaaagaagttaaaatggtgtggcaggtcattaggattaggcagaatctctcagagctgctggacaaggaggtctacttattttgtgtggatggtaattatggcatgcacgctgaatgcagttctgagcatggcagcggcccctgagggtcagatcagaattgcccacaatgtgttttttaactaggaccaggtgcagcatgctagtcttgattggaaagatttgacaggatgctaattactgaacagtgggttttgtcaacgccctggtttcagaatatgaactgaggagtcaaacagttggaaacagcacattgctgatttacactggatcttgccttagaaaccattgtctgcctgcctaaccagcctttcataaaatttaaacaaaactctttctacgtagtgatcctcaagcaatatttttgatacagcaagtgtcaaacttgctatagcataaaagccggggctcctgatttccaggtttctaaaaaggaactgaggtaaaacagatgcctgaccgttttaaaggatcttttttaatgttttatgactgcctgtctgtttgaatactggcaaagggataaataataaattgacatcaaaaagtactaatgaaaaattt

SEQ ID NO: 308157 - DNA, 1953 bp, Homo sapiens
aatagcgaaggggcggggcgcagatctgtttccctcagactccatctgcccggggccgctaagggagcgcaaggtcaagttcgccttggccctgcctccagctcaggtactagggggtctagacctgaggctgcccgggccggaggcagccttgagtcccgagaccaaacgtcgtttccctctcggacctcgggcgccgggccgcgcgctgaccgacagcccctgctaggcccagcaggtcccctagtcccccgcagtcccccgagactcgccgagcgccgttgctgagccctgcaaatagcagctacctgcttcagcctagatcctgccatgaagcggactgctgctccctggctcccactctgatctgcttttcactcttgccttgtctcccaattaataagcagggtggccactgcaacaggtgtggatgtgcctgacaagatgaagagccgaatacctgtggtgctcctggcctgtggctcctttaaccccatcaccaacatgcacctgcgcatgtttgaggtggccagagatcacctacaccaaacaggaatgtaccaggtcatccagggtatcatctctcctgtcaacgacacctatgggaagaaagacctcgcagcttctcatcaccgagtggccatggcccggctggccctgcagacatccgactggatccgggtggacccttgggagagtgagcaggcacagtggatggagacagtgaaggtgctgagctgtgcctgagctgaagcttctctgtggggcagacgtcttgaagaccttccagacccccaacctctggaaggatgcgcacatccaggaaatagtggagaagtttggcttggtgtgcgtgggccgagtaggtcacgacccaaaaggttacatcgcagaatctcccatcctacggatgcaccagcacaacattcacctggccaaggagcctgtgcagaatgagatcagtgccacatacatcaggcgagccttgggccaagggcagagcgtaaagtacctgattcccgatgctgtcatcacgtacatcaaggaccatggcctctacaccaagggcagtacctggaaaggcaaaagcacccagagcactgagggcaagacaagctagggaggggggactcagcacccacacctcctccaacaagctcctgctggggagagggctgttaaggtttctgttttactttggtttttgcttctccatttttcatttgctttatttctacagtgattctacttctgaggagtcttctgtcccaggaagagataccttctttacaggagaggaaaggtctaaatcacaaggatagacatttatcaaagaagttaaaatggtgtggcaggtcattaggattaggcagaatctctcagagctgctggacaaggaggtctacttattttgtgtggatggtaattatggcatgcacgctgaatgcagttctgagcatggcagcggcccctgagggtcagatcagaattgcccacaatgtgttttttaactaggaccaggtgcagcatgctagtcttgattggaaagatttgacaggatgctaattactgaacagtgggttttgtcaacgccctggtttcagaatatgaactgaggagtcaaacagttggaaacagcacattgctgatttacactggatcttgccttagaaaccattgtctgcctgcctaaccagcctttcataaaatttaaacaaaactctttctacgtagtgatcctcaagcaatatttttgatacagcaagtgtcaaacttgctatagcataaaagccggggctcctgatttccaggtttctaaaaaggaactgaggtaaaacagatgcctgaccgttttaaaggatcttttttaatgttttatgactgcctgtctgtttgaatactggcaaagggataaataataaattgacatcaaaaagtactaatgaaaaattt

SEQ ID NO: 308158 - DNA, 1887 bp, Homo sapiens
aatagcgaaggggcggggcgcagatctgtttccctcagactccatctgcccggggccgctaagggagcgcaaggtcaagttcgccttggccctgcctccagctcaggtactagggggtctagacctgaggctgcccgggccggaggcagccttgagtcccgagaccaaacgtcgtttccctctcggacctcgggcgccgggccgcgcgctgaccgacagcccctgctaggcccagcaggtcccctagtcccccgcagtcccccgagactcgccgagcgccgttgctgagccctgcaaatagcagctacctgcttcagcctagatcctgccatgaagcggactgctgctccctggctcccactctgatctgcttttcactcttgccttgtctcccaattaataaggaatgtaccaggtcatccagggtatcatctctcctgtcaacgacacctatgggaagaaagacctcgcagcttctcatcaccgagtggccatggcccggctggccctgcagacatccgactggatccgggtggacccttgggagagtgagcaggcacagtggatggagacagtgaaggtgctgaggcatcatcacagcaaactgctcagatctccaccccagatggaaggcccagaccatggcaaggcactcttctcgacccctgcagctgtgcctgagctgaagcttctctgtggggcagacgtcttgaagaccttccagacccccaacctctggaaggatgcgcacatccaggaaatagtggagaagtttggcttggtgtgcgtgggccgagtaggtcacgacccaaaaggttacatcgcagaatctcccatcctacggatgcaccagcacaacattcacctggccaaggagcctgtgcagaatgagatcagtgccacatacatcaggcgagccttgggccaagggcagagcgtaaagtacctgattcccgatgctgtcatcacgtacatcaaggaccatggcctctacaccaagggcagtacctggaaaggcaaaagcacccagagcactgagggcaagacaagctagggaggggggactcagcacccacacctcctccaacaagctcctgctggggagagggctgttaaggtttctgttttactttggtttttgcttctccatttttcatttgctttatttctacagtgattctacttctgaggagtcttctgtcccaggaagagataccttctttacaggagaggaaaggtctaaatcacaaggatagacatttatcaaagaagttaaaatggtgtggcaggtcattaggattaggcagaatctctcagagctgctggacaaggaggtctacttattttgtgtggatggtaattatggcatgcacgctgaatgcagttctgagcatggcagcggcccctgagggtcagatcagaattgcccacaatgtgttttttaactaggaccaggtgcagcatgctagtcttgattggaaagatttgacaggatgctaattactgaacagtgggttttgtcaacgccctggtttcagaatatgaactgaggagtcaaacagttggaaacagcacattgctgatttacactggatcttgccttagaaaccattgtctgcctgcctaaccagcctttcataaaatttaaacaaaactctttctacgtagtgatcctcaagcaatatttttgatacagcaagtgtcaaacttgctatagcataaaagccggggctcctgatttccaggtttctaaaaaggaactgaggtaaaacagatgcctgaccgttttaaaggatcttttttaatgttttatgactgcctgtctgtttgaatactggcaaagggataaataataaattgacatcaaaaagtactaatgaaaaattt

SEQ ID NO: 308159 - DNA, 1634 bp, Homo sapiens
aagtcatcttttaaacgcaaaagaactgaagaacaagcgttctgtgatttgaatgacagcaagtgcaaaggcacaacactgaaaaaaattatatttatagatagcacctggaaccaaacaaacaaaatattcactgatgagcgacttcaaggaatgtaccaggtcatccagggtatcatctctcctgtcaacgacacctatgggaagaaagacctcgcagcttctcatcaccgagtggccatggcccggctggccctgcagacatccgactggatccgggtggacccttgggagagtgagcaggcacagtggatggagacagtgaaggtgctgaggcatcatcacagcaaactgctcagatctccaccccagatggaaggcccagaccatggcaaggcactcttctcgacccctgcagctgtgcctgagctgaagcttctctgtggggcagacgtcttgaagaccttccagacccccaacctctggaaggatgcgcacatccaggaaatagtggagaagtttggcttggtgtgcgtgggccgagtaggtcacgacccaaaaggttacatcgcagaatctcccatcctacggatgcaccagcacaacattcacctggccaaggagcctgtgcagaatgagatcagtgccacatacatcaggcgagccttgggccaagggcagagcgtaaagtacctgattcccgatgctgtcatcacgtacatcaaggaccatggcctctacaccaagggcagtacctggaaaggcaaaagcacccagagcactgagggcaagacaagctagggaggggggactcagcacccacacctcctccaacaagctcctgctggggagagggctgttaaggtttctgttttactttggtttttgcttctccatttttcatttgctttatttctacagtgattctacttctgaggagtcttctgtcccaggaagagataccttctttacaggagaggaaaggtctaaatcacaaggatagacatttatcaaagaagttaaaatggtgtggcaggtcattaggattaggcagaatctctcagagctgctggacaaggaggtctacttattttgtgtggatggtaattatggcatgcacgctgaatgcagttctgagcatggcagcggcccctgagggtcagatcagaattgcccacaatgtgttttttaactaggaccaggtgcagcatgctagtcttgattggaaagatttgacaggatgctaattactgaacagtgggttttgtcaacgccctggtttcagaatatgaactgaggagtcaaacagttggaaacagcacattgctgatttacactggatcttgccttagaaaccattgtctgcctgcctaaccagcctttcataaaatttaaacaaaactctttctacgtagtgatcctcaagcaatatttttgatacagcaagtgtcaaacttgctatagcataaaagccggggctcctgatttccaggtttctaaaaaggaactgaggtaaaacagatgcctgaccgttttaaaggatcttttttaatgttttatgactgcctgtctgtttgaatactggcaaagggataaataataaattgacatcaaaaagtactaatgaaaaattt

SEQ ID NO: 308160 - DNA, 692 bp, Homo sapiens
aatagcgaaggggcggggcgcagatctgtttccctcagactccatctgcccggggccgctaagggagcgcaaggtcaagttcgccttggccctgcctccagctcaggtactagggggtctagacctgaggctgcccgggccggaggcagccttgagtcccgagaccaaacgtcgtttccctctcggacctcgggcgccgggccgcgcgctgaccgacagcccctgctaggcccagcaggtcccctagtcccccgcagtcccccgagactcgccgagcgccgttgctgagccctgcaaatagcagctacctgcttcagcctagatcctgccatgaagcggactgctgctccctggctcccactctgatctgcttttcactcttgccttgtctcccaattaataaggggtggctggcagaggatccttacaccgacaaggaaggtatgctttgcttttgtttttagcagcattgtgtgcccgtagcaacagcgggttaaaaagaaaaagtactggagatcgcatgaaggttgattgccctagagaagtcgacacgctcacacagatggaaatgatttcaccgagtcctgaaaaatgtggtcgtcagccccacatacaaaccacgacttgtgttttctttaagatgaggagtctggtcaagaggtctgtgtaataaaagatgtttgtagaatcca

SEQ ID NO: 308161 - DNA, 629 bp, Homo sapiens
aatagcgaaggggcggggcgcagatctgtttccctcagactccatctgcccggggccgctaagggagcgcaaggtcaagttcgccttggccctgcctccagctcaggtactagggggtctagacctgaggctgcccgggccggaggcagccttgagtcccgagaccaaacgtcgtttccctctcggacctcgggcgccgggccgcgcgctgaccgacagcccctgctaggcccagcaggtcccctagtcccccgcagtcccccgagactcgccgagcgccgttgctgagccctgcaaatagcagctacctgcttcagcctagatcctgccatgaagcggactgctgctccctggctcccactctgatctgcttttcactcttgccttgtctcccaattaataagcattgtgtgcccgtagcaacagcgggttaaaaagaaaaagtactggagatcgcatgaaggttgattgccctagagaagtcgacacgctcacacagatggaaatgatttcaccgagtcctgaaaaatgtggtcgtcagccccacatacaaaccacgacttgtgttttctttaagatgaggagtctggtcaagaggtctgtgtaataaaagatgtttgtagaatcca

SEQ ID NO: 308162 - DNA, 282 bp, Homo sapiens
ctcccacctacattcaaaatacccgcagactttcagctacctgcttcagcctagatcctgccatgaagcggactgctgctccctggctcccactctgatctgcttttcactcttgccttgtctcccaattaataagcagggcacagtgggacgtgcctgtaatcccagttactcaggaggaagaggcaggagaatcacttgaacctgggaggcagaggctgcggtgagttgagatcgtgccattgcactccagcctgggcaacaagagcaaaacgctatctc

SEQ ID NO: 308163 - DNA, 2073 bp, Homo sapiens
aatagcgaaggggcggggcgcagatctgtttccctcagactccatctgcccggggccgctaagggagcgcaaggtcaagttcgccttggccctgcctccagctcaggtactagggggtctagacctgaggctgcccgggccggaggcagccttgagtcccgagaccaaacgtcgtttccctctcggacctcgggcgccgggccgcgcgctgaccgacagcccctgctaggcccagcaggtcccctagtcccccgcagtcccccgagactcgccgagcgccgttgctgagccctgcaaatagcagctacctgcttcagcctagatcctgccatgaagcggactgctgctccctggctcccactctgatctgcttttcactcttgccttgtctcccaattaataaggggtggctggcagaggatccttacaccgacaaggaagcagggtggccactgcaacaggtgtggatgtgcctgacaagatgaagagccgaatacctgtggtgctcctggcctgtggctcctttaaccccatcaccaacatgcacctgcgcatgtttgaggtggccagagatcacctacaccaaacaggaatgtaccaggtcatccagggtatcatctctcctgtcaacgacacctatgggaagaaagacctcgcagcttctcatcaccgagtggccatggcccggctggccctgcagacatccgactggatccgggtggacccttgggagagtgagcaggcacagtggatggagacagtgaaggtgctgaggcatcatcacagcaaactgctcagatctccaccccagatggaaggcccagaccatggcaaggcactcttctcgacccctgcagctgtgcctgagctgaagcttctctgtggggcagacgtcttgaagaccttccagacccccaacctctggaaggatgcgcacatccaggaaatagtggagaagtttggcttggtgtgcgtgggccgagtaggtcacgacccaaaaggttacatcgcagaatctcccatcctacggatgcaccagcacaacattcacctggccaaggagcctgtgcagaatgagatcagtgccacatacatcaggcgagccttgggccaagggcagagcgtaaagtacctgattcccgatgctgtcatcacgtacatcaaggaccatggcctctacaccaagggcagtacctggaaaggcaaaagcacccagagcactgagggcaagacaagctagggaggggggactcagcacccacacctcctccaacaagctcctgctggggagagggctgttaaggtttctgttttactttggtttttgcttctccatttttcatttgctttatttctacagtgattctacttctgaggagtcttctgtcccaggaagagataccttctttacaggagaggaaaggtctaaatcacaaggatagacatttatcaaagaagttaaaatggtgtggcaggtcattaggattaggcagaatctctcagagctgctggacaaggaggtctacttattttgtgtggatggtaattatggcatgcacgctgaatgcagttctgagcatggcagcggcccctgagggtcagatcagaattgcccacaatgtgttttttaactaggaccaggtgcagcatgctagtcttgattggaaagatttgacaggatgctaattactgaacagtgggttttgtcaacgccctggtttcagaatatgaactgaggagtcaaacagttggaaacagcacattgctgatttacactggatcttgccttagaaaccattgtctgcctgcctaaccagcctttcataaaatttaaacaaaactctttctacgtagtgatcctcaagcaatatttttgatacagcaagtgtcaaacttgctatagcataaaagccggggctcctgatttccaggtttctaaaaaggaactgaggtaaaacagatgcctgaccgttttaaaggatcttttttaatgttttatgactgcctgtctgtttgaatactggcaaagggataaataataaattgacatcaaaaagtactaatgaaaaattt

SEQ ID NO: 308164 - DNA, 2036 bp, Homo sapiens
aatagcgaaggggcggggcgcagatctgtttccctcagactccatctgcccggggccgctaagggagcgcaaggtcaagttcgccttggccctgcctccagctcaggtactagggggtctagacctgaggctgcccgggccggaggcagccttgagtcccgagaccaaacgtcgtttccctctcggacctcgggcgccgggccgcgcgctgaccgacagcccctgctaggcccagcaggtcccctagtcccccgcagtcccccgagactcgccgagcgccgttgctgagccctgcaaatagcagctacctgcttcagcctagatcctgccatgaagcggactgctgctccctggctcccactctgatctgcttttcactcttgccttgtctcccaattaataagcagggtggccactgcaacaggtgtggatgtgcctgacaagatgaagagccgaatacctgtggtgctcctggcctgtggctcctttaaccccatcaccaacatgcacctgcgcatgtttgaggtggccagagatcacctacaccaaacaggaatgtaccaggtcatccagggtatcatctctcctgtcaacgacacctatgggaagaaagacctcgcagcttctcatcaccgagtggccatggcccggctggccctgcagacatccgactggatccgggtggacccttgggagagtgagcaggcacagtggatggagacagtgaaggtgctgaggcatcatcacagcaaactgctcagatctccaccccagatggaaggcccagaccatggcaaggcactcttctcgacccctgcagctgtgcctgagctgaagcttctctgtggggcagacgtcttgaagaccttccagacccccaacctctggaaggatgcgcacatccaggaaatagtggagaagtttggcttggtgtgcgtgggccgagtaggtcacgacccaaaaggttacatcgcagaatctcccatcctacggatgcaccagcacaacattcacctggccaaggagcctgtgcagaatgagatcagtgccacatacatcaggcgagccttgggccaagggcagagcgtaaagtacctgattcccgatgctgtcatcacgtacatcaaggaccatggcctctacaccaagggcagtacctggaaaggcaaaagcacccagagcactgagggcaagacaagctagggaggggggactcagcacccacacctcctccaacaagctcctgctggggagagggctgttaaggtttctgttttactttggtttttgcttctccatttttcatttgctttatttctacagtgattctacttctgaggagtcttctgtcccaggaagagataccttctttacaggagaggaaaggtctaaatcacaaggatagacatttatcaaagaagttaaaatggtgtggcaggtcattaggattaggcagaatctctcagagctgctggacaaggaggtctacttattttgtgtggatggtaattatggcatgcacgctgaatgcagttctgagcatggcagcggcccctgagggtcagatcagaattgcccacaatgtgttttttaactaggaccaggtgcagcatgctagtcttgattggaaagatttgacaggatgctaattactgaacagtgggttttgtcaacgccctggtttcagaatatgaactgaggagtcaaacagttggaaacagcacattgctgatttacactggatcttgccttagaaaccattgtctgcctgcctaaccagcctttcataaaatttaaacaaaactctttctacgtagtgatcctcaagcaatatttttgatacagcaagtgtcaaacttgctatagcataaaagccggggctcctgatttccaggtttctaaaaaggaactgaggtaaaacagatgcctgaccgttttaaaggatcttttttaatgttttatgactgcctgtctgtttgaatactggcaaagggataaataataaattgacatcaaaaagtactaatgaaaaattt

SEQ ID NO: 308165 - DNA, 3600 bp, Homo sapiens
aagtgcacggaggagttccgggggccaggcggccgccgcgagtctggtatcctgagcttcgtgagttgagcgctgctgctccgcggtggagtcaccgcaccgctcccgggatcatggtgttctacttcaccagcagcagcgttaattcatctgcctacactatttacatgggaaaagataaatatgaaaatgaagatctgatcaagcatggctggcctgaagatatctgggagagaatatagaagacatcccaaaggaagtgctgatggactgtgcccaccttgtgaaggccaatagcattcaaggctgcaagatgaacaacgttaatgtggtatatacgccgtggtctaacctgaagaaaacagctgacatggatgtggggcagataggctttcacaggcagaaggatgtaaaaattgtgacagtggagaagaaagtaaatgagatcctgaaccgattagaaaagaccaaagtcgagcggttcccagacctagcagcagagaaagaatgcagagatcgtgaagagaggaatgagaaaaaagcccaaattcaggaaatgaaaaagagagaaaaagaagaaatgaagaagaagagggaaatggatgaacttaggagctattcatcactaatgaaagttgaaaatatgtcttcaaatcaggatggcaatgattcagatgaattcatgtaaaaggagaaaaggagaaaaggacctttgaaagatgtgaatgtagagacaattgcagaccttttggtttcatctgtgttctgaagtataaaatacaaccaaaattctaccttcatcctacccagaaattattgattttcaagttttaaaaaaattgtaccttttttgctgacagaaaaggatcagatatgtataaaatagttgaacttgacagcatataacttaaagtgaaaatgtttttgccagaacatgtcttggtaccttgtgaaagcaggctgcccttgttcttgagatagactttaaaatgaaccagctctgaaaagtacttctgctgctctggtctatccctgaaaacagatgtcttgaaacacttttcatattcttaaaataatcttcacttctgttaagaagaacatgttggtgggtaattatgcgaatgtttccctgtccctgatttctcgattaggcgtatgggttttgaaaaagagatttttcagaagattgtcagcttcagtattcacgttccatcgtgtcatctgggtctgttagtgtagtgaccctcagtgcagtctgtcccagcgtttacgtccttgcttcctctgagcagaggcctccatcttagtatcaacatatttaaagaaattgatggtgttcatcaagctggggcctgtggcagttgttgcctgagcaccaagtaacccaagccacctatgtgacaacttctgggcccaggagtaatttctcagcattgagggtaaaataggatggagtgctctgttgatcatttgggagatgtaggttacctgatttgtgccttaggatgcagcgtgaagcagaagtccatattgcaattatgattttagaaggaactaagcattttactcacacccacagcagcaagaatgacctcctgcagcagatattccacctgtaatagcactttggaactgtgggcaaaaccaaaaggctagtgtttccatttattccatgttggtgtatggggttgaactggaaaattccctgaggcaaaactcactggccaaattttgagagggtatagaaaatgactttagagatgagtggttttgtgtatgtgtctgatgatattcagtctgatgttccgcaattttaaaagttataataaaataccatttttttaatctggaaggacattgatatatgaattcttagaatttgctattaaaaagggtagcccccattccacaagctggttttgagggtgatcttgctctaaaaaacctcattcatcataggctcagtctgacaggttctgtacggggctatcatctttctcctcctctgctaaatgcctctttcttccagctgctcactgggtcaaagggatgtcctttctcagatgtattcttgatacatctcagatgtattcgtagctgtgctccttccatacttccaaggagtccggcttctacagaattcctctgtacctcacactgcaacacatgtagatagcgcttttgaaaaatacatatatttttactatagtatgagaggtcctggggctcaaactttaaacatttcctaactcagcttacactggtttaaaatgtccaggtctctgctgaattctcttgttgaattcatagctctccaacctcctctgtgttgattcctatgcccctaaccctgcagcctctttgttttatttttttccccatctctgttggtcccagggaaagcaaggaaattttcttttgaggacttataggttgattgcccacaggtcaaactgttggcattgaactcctctcatttcttgccattggattgtttcctaaacgttggataggagaattcgaaattgttgctatttttatgagctgtgcccttgatcaaatctgtgctgtgggtctgagtcattttgccaatgtcgtcttcagtttcaacactctgatcagcatgcaggcgaggggcatgtttaatttacttcactaactgctatattctatagctttagacttcatatttcttatccacctttgtctaggctcacgatctttgggcaagggagctttgtcaccgtggttgggctagaacaaatattgagaagtttaccaacacagatgttgagaagtttattgaaaggcactgacattagcagaataagtgatggacattagttgaaccccttcagtgtctatgtgttttattgtattgtctttaactcgttcttgaagcacagatttcagcgagcctttcagctattcagtgccagcggttttccccactcaggaaagatggtgtgagccatacacacagcaggattagacggggagagtttcagctgcagcttctagtttaagaccaaagcccttcctcccgctgctgcatctgtctgagaggggaagctcttgttttccaagctggaaccgtttatgaggaaaactgagcagggtggcaaaatggaaaaggaacaattttctagtttttcctacgcgtgatattgacgcgtgctttttctttgatttgaggtacagcatgtaaataacaaatttccatattcaaaatgatcatattagagtgactgagtgaccttttgattttgaagcagactaaaatctgaccagaccacaatgaaaagtataaaattagaaacttaaattccaagctaaatttcagctttgacccacctaactccagtgaataggtggcagctcagaaacaaggacagcactgctgctgccagagcaagctcacatccagctggcacttcgtgagagctccttcctgccgggcacgtgtgagttcagcgtgggcaagagacttttatgcacattctgtcattcaaaagggaaatgatgccaaccccagatgcagcatgtcctgaatgaatgatctgtaaaatacaataataaaagcttatagtttgagtagaa

SEQ ID NO: 308166 - DNA, 1903 bp, Homo sapiens
aagtgcacggaggagttccgggggccaggcggccgccgcgagtctggtatcctgagcttcgtgagttgagcgctgctgctccgcggtggagtcaccgcaccgctcccgggatcatggtgttctacttcaccagcagcagcgttaattcatctgcctacactatttacatgggaaaagataaatatgaaaatgaagatctgatcaagcatggctggcctgaagatatctggtttcatgtggacaaactctcttcggctcatgtataccttcgattacataagggagagaatatagaagacatcccaaaggaagtgctgatggactgtgcccaccttgtgaaggccaatagcattcaaggctgcaagatgaacaacgttaatgtggtatatacgccgtggtctaacctgaagaaaacagctgacatggatgtggggcagataggctttcacaggcagaaggatgtaaaaattgtgacagtggagaagaaagtaaatgagatcctgaaccgattagaaaagaccaaagtcgagcggttcccagacctagcagcagagaaagaatgcagagatcgtgaagagaggaatgagaaaaaagcccaaattcaggaaatgaaaaagagagaaaaagaagaaatgaagaagaagagggaaatggatgaacttaggagctattcatcactaatgaaagttgaaaatatgtcttcaaatcaggatggcaatgattcagatgaattcatgtaaaaggagaaaaggagaaaaggacctttgaaagatgtgaatgtagagacaattgcagaccttttggtttcatctgtgttctgaagtataaaatacaaccaaaattctaccttcatcctacccagaaattattgattttcaagttttaaaaaaattgtaccttttttgctgacagaaaaggatcagatatgtataaaatagttgaacttgacagcatataacttaaagtgaaaatgtttttgccagaacatgtcttggtaccttgtgaaagcaggctgcccttgttcttgagatagactttaaaatgaaccagctctgaaaagtacttctgctgctctggtctatccctgaaaacagatgtcttgaaacacttttcatattcttaaaataatcttcacttctgttaagaagaacatgttggtgggtaattatgcgaatgtttccctgtccctgatttctcgattaggcgtatgggttttgaaaaagagatttttcagaagattgtcagcttcagtattcacgttccatcgtgtcatctgggtctgttagtgtagtgaccctcagtgcagtctgtcccagcgtttacgtccttgcttcctctgagcagaggcctccatcttagtatcaacatatttaaagaaattgatggtgttcatcaagctggggcctgtggcagttgttgcctgagcaccaagtaacccaagccacctatgtgacaacttctgggcccaggagtaatttctcagcattgagggtaaaataggatggagtgctctgttgatcatttgggagatgtaggttacctgatttgtgccttaggatgcagcgtgaagcagaagtccatattgcaattatgattttagaaggaactaagcattttactcacacccacagcagcaagaatgacctcctgcagcagatattccacctgtaatagcactttggaactgtgggcaaaaccaaaaggctagtgtttccatttattccatgttggtgtatggggttgaactggaaaattccctgaggcaaaactcactggccaaattttgagagggtatagaaaatgactttagagatgagtggttttgtgtatgtgtctgatgatattcagtctgatgttccgcaattttaaaagttataataaaataccatttttttaatctgga

SEQ ID NO: 308167 - DNA, 825 bp, Homo sapiens
aagtgcacggaggagttccgggggccaggcggccgccgcgagtctggtatcctgagcttcgtgagttgagcgctgctgctccgcggtggagtcaccgcaccgctcccgggatcatggtgttctacttcaccagcagcagcgttaattcatctgcctacactatttacatgggaaaagataaatatgaaaatgaagatctgatcaagcatggctggcctgaagatatctgggagagaatatagaagacatcccaaaggaagtgctgatggactgtgcccaccttgtgaaggccaatagcattcaaggtaaaaattgtgacagtggagaagaaagtaaatgagatcctgaaccgattagaaaagaccaaagtcgagcggttcccagacctagcagcagagaaagaatgcagagatcgtgaagagaggaatgagaaaaaagcccaaattcaggaaatgaaaaagagagaaaaagaagaaatgaagaagaagagggaaatggatgaacttaggagctattcatcactaatgaaagttgaaaatatgtcttcaaatcaggatggcaatgattcagatgaattcatgtaaaaggagaaaaggagaaaaggacctttgaaagatgtgaatgtagagacaattgcagaccttttggtttcatctgtgttctgaagtataaaatacaaccaaaattctaccttcatcctacccagaaattattgattttcaagttttaaaaaaattgtaccttttttgctgacagaaagaacaaattttttaaattgacctgccgcattacttaaaggaatagtttcccaacatgttgtgcctt

SEQ ID NO: 308168 - DNA, 3652 bp, Homo sapiens
aagtgcacggaggagttccgggggccaggcggccgccgcgagtctggtatcctgagcttcgtgagttgagcgctgctgctccgcggtggagtcaccgcaccgctcccgggatcatggtgttctacttcaccagcagcagcgttaattcatctgcctacactatttacatgggaaaagataaatatgaaaatgaagatctgatcaagcatggctggcctgaagatatctggtttcatgtggacaaactctcttcggctcatgtataccttcgattacataagggagagaatatagaagacatcccaaaggaagtgctgatggactgtgcccaccttgtgaaggccaatagcattcaaggctgcaagatgaacaacgttaatgtggtatatacgccgtggtctaacctgaagaaaacagctgacatggatgtggggcagataggctttcacaggcagaaggatgtaaaaattgtgacagtggagaagaaagtaaatgagatcctgaaccgattagaaaagaccaaagtcgagcggttcccagacctagcagcagagaaagaatgcagagatcgtgaagagaggaatgagaaaaaagcccaaattcaggaaatgaaaaagagagaaaaagaagaaatgaagaagaagagggaaatggatgaacttaggagctattcatcactaatgaaagttgaaaatatgtcttcaaatcaggatggcaatgattcagatgaattcatgtaaaaggagaaaaggagaaaaggacctttgaaagatgtgaatgtagagacaattgcagaccttttggtttcatctgtgttctgaagtataaaatacaaccaaaattctaccttcatcctacccagaaattattgattttcaagttttaaaaaaattgtaccttttttgctgacagaaaaggatcagatatgtataaaatagttgaacttgacagcatataacttaaagtgaaaatgtttttgccagaacatgtcttggtaccttgtgaaagcaggctgcccttgttcttgagatagactttaaaatgaaccagctctgaaaagtacttctgctgctctggtctatccctgaaaacagatgtcttgaaacacttttcatattcttaaaataatcttcacttctgttaagaagaacatgttggtgggtaattatgcgaatgtttccctgtccctgatttctcgattaggcgtatgggttttgaaaaagagatttttcagaagattgtcagcttcagtattcacgttccatcgtgtcatctgggtctgttagtgtagtgaccctcagtgcagtctgtcccagcgtttacgtccttgcttcctctgagcagaggcctccatcttagtatcaacatatttaaagaaattgatggtgttcatcaagctggggcctgtggcagttgttgcctgagcaccaagtaacccaagccacctatgtgacaacttctgggcccaggagtaatttctcagcattgagggtaaaataggatggagtgctctgttgatcatttgggagatgtaggttacctgatttgtgccttaggatgcagcgtgaagcagaagtccatattgcaattatgattttagaaggaactaagcattttactcacacccacagcagcaagaatgacctcctgcagcagatattccacctgtaatagcactttggaactgtgggcaaaaccaaaaggctagtgtttccatttattccatgttggtgtatggggttgaactggaaaattccctgaggcaaaactcactggccaaattttgagagggtatagaaaatgactttagagatgagtggttttgtgtatgtgtctgatgatattcagtctgatgttccgcaattttaaaagttataataaaataccatttttttaatctggaaggacattgatatatgaattcttagaatttgctattaaaaagggtagcccccattccacaagctggttttgagggtgatcttgctctaaaaaacctcattcatcataggctcagtctgacaggttctgtacggggctatcatctttctcctcctctgctaaatgcctctttcttccagctgctcactgggtcaaagggatgtcctttctcagatgtattcttgatacatctcagatgtattcgtagctgtgctccttccatacttccaaggagtccggcttctacagaattcctctgtacctcacactgcaacacatgtagatagcgcttttgaaaaatacatatatttttactatagtatgagaggtcctggggctcaaactttaaacatttcctaactcagcttacactggtttaaaatgtccaggtctctgctgaattctcttgttgaattcatagctctccaacctcctctgtgttgattcctatgcccctaaccctgcagcctctttgttttatttttttccccatctctgttggtcccagggaaagcaaggaaattttcttttgaggacttataggttgattgcccacaggtcaaactgttggcattgaactcctctcatttcttgccattggattgtttcctaaacgttggataggagaattcgaaattgttgctatttttatgagctgtgcccttgatcaaatctgtgctgtgggtctgagtcattttgccaatgtcgtcttcagtttcaacactctgatcagcatgcaggcgaggggcatgtttaatttacttcactaactgctatattctatagctttagacttcatatttcttatccacctttgtctaggctcacgatctttgggcaagggagctttgtcaccgtggttgggctagaacaaatattgagaagtttaccaacacagatgttgagaagtttattgaaaggcactgacattagcagaataagtgatggacattagttgaaccccttcagtgtctatgtgttttattgtattgtctttaactcgttcttgaagcacagatttcagcgagcctttcagctattcagtgccagcggttttccccactcaggaaagatggtgtgagccatacacacagcaggattagacggggagagtttcagctgcagcttctagtttaagaccaaagcccttcctcccgctgctgcatctgtctgagaggggaagctcttgttttccaagctggaaccgtttatgaggaaaactgagcagggtggcaaaatggaaaaggaacaattttctagtttttcctacgcgtgatattgacgcgtgctttttctttgatttgaggtacagcatgtaaataacaaatttccatattcaaaatgatcatattagagtgactgagtgaccttttgattttgaagcagactaaaatctgaccagaccacaatgaaaagtataaaattagaaacttaaattccaagctaaatttcagctttgacccacctaactccagtgaataggtggcagctcagaaacaaggacagcactgctgctgccagagcaagctcacatccagctggcacttcgtgagagctccttcctgccgggcacgtgtgagttcagcgtgggcaagagacttttatgcacattctgtcattcaaaagggaaatgatgccaaccccagatgcagcatgtcctgaatgaatgatctgtaaaatacaataataaaagcttatagtttgagtagaa

SEQ ID NO: 308169 - DNA, 3900 bp, Homo sapiens
aagtgcacggaggagttccgggggccaggcggccgccgcgagtctggtatcctgagcttcgtgagttgagcgctgctgctccgcggtggagtcaccgcaccgctcccgggatcatggtgttctacttcaccagcagcagcgttaattcatctgcctacactatttacatgggaaaagataaatatgaaagctgaggcgagaggatcacttgagcccaggagttcgagacctgcctgagcaacatagggagaccctgtctctacaaaaaacaacaataaaagaaaatattagctgggcatagtgacacacacctgttgtccttgctactctggaggctgaggcaggaagatcgcttgagcctgggaggtaggctgcagtgagctgtgatcatgccactgcattccagcttaagagacagcgagaatctgttgtctgaaatgaagatctgatcaagcatggctggcctgaagatatctggtttcatgtggacaaactctcttcggctcatgtataccttcgattacataagggagagaatatagaagacatcccaaaggaagtgctgatggactgtgcccaccttgtgaaggccaatagcattcaaggctgcaagatgaacaacgttaatgtggtatatacgccgtggtctaacctgaagaaaacagctgacatggatgtggggcagataggctttcacaggcagaaggatgtaaaaattgtgacagtggagaagaaagtaaatgagatcctgaaccgattagaaaagaccaaagtcgagcggttcccagacctagcagcagagaaagaatgcagagatcgtgaagagaggaatgagaaaaaagcccaaattcaggaaatgaaaaagagagaaaaagaagaaatgaagaagaagagggaaatggatgaacttaggagctattcatcactaatgaaagttgaaaatatgtcttcaaatcaggatggcaatgattcagatgaattcatgtaaaaggagaaaaggagaaaaggacctttgaaagatgtgaatgtagagacaattgcagaccttttggtttcatctgtgttctgaagtataaaatacaaccaaaattctaccttcatcctacccagaaattattgattttcaagttttaaaaaaattgtaccttttttgctgacagaaaaggatcagatatgtataaaatagttgaacttgacagcatataacttaaagtgaaaatgtttttgccagaacatgtcttggtaccttgtgaaagcaggctgcccttgttcttgagatagactttaaaatgaaccagctctgaaaagtacttctgctgctctggtctatccctgaaaacagatgtcttgaaacacttttcatattcttaaaataatcttcacttctgttaagaagaacatgttggtgggtaattatgcgaatgtttccctgtccctgatttctcgattaggcgtatgggttttgaaaaagagatttttcagaagattgtcagcttcagtattcacgttccatcgtgtcatctgggtctgttagtgtagtgaccctcagtgcagtctgtcccagcgtttacgtccttgcttcctctgagcagaggcctccatcttagtatcaacatatttaaagaaattgatggtgttcatcaagctggggcctgtggcagttgttgcctgagcaccaagtaacccaagccacctatgtgacaacttctgggcccaggagtaatttctcagcattgagggtaaaataggatggagtgctctgttgatcatttgggagatgtaggttacctgatttgtgccttaggatgcagcgtgaagcagaagtccatattgcaattatgattttagaaggaactaagcattttactcacacccacagcagcaagaatgacctcctgcagcagatattccacctgtaatagcactttggaactgtgggcaaaaccaaaaggctagtgtttccatttattccatgttggtgtatggggttgaactggaaaattccctgaggcaaaactcactggccaaattttgagagggtatagaaaatgactttagagatgagtggttttgtgtatgtgtctgatgatattcagtctgatgttccgcaattttaaaagttataataaaataccatttttttaatctggaaggacattgatatatgaattcttagaatttgctattaaaaagggtagcccccattccacaagctggttttgagggtgatcttgctctaaaaaacctcattcatcataggctcagtctgacaggttctgtacggggctatcatctttctcctcctctgctaaatgcctctttcttccagctgctcactgggtcaaagggatgtcctttctcagatgtattcttgatacatctcagatgtattcgtagctgtgctccttccatacttccaaggagtccggcttctacagaattcctctgtacctcacactgcaacacatgtagatagcgcttttgaaaaatacatatatttttactatagtatgagaggtcctggggctcaaactttaaacatttcctaactcagcttacactggtttaaaatgtccaggtctctgctgaattctcttgttgaattcatagctctccaacctcctctgtgttgattcctatgcccctaaccctgcagcctctttgttttatttttttccccatctctgttggtcccagggaaagcaaggaaattttcttttgaggacttataggttgattgcccacaggtcaaactgttggcattgaactcctctcatttcttgccattggattgtttcctaaacgttggataggagaattcgaaattgttgctatttttatgagctgtgcccttgatcaaatctgtgctgtgggtctgagtcattttgccaatgtcgtcttcagtttcaacactctgatcagcatgcaggcgaggggcatgtttaatttacttcactaactgctatattctatagctttagacttcatatttcttatccacctttgtctaggctcacgatctttgggcaagggagctttgtcaccgtggttgggctagaacaaatattgagaagtttaccaacacagatgttgagaagtttattgaaaggcactgacattagcagaataagtgatggacattagttgaaccccttcagtgtctatgtgttttattgtattgtctttaactcgttcttgaagcacagatttcagcgagcctttcagctattcagtgccagcggttttccccactcaggaaagatggtgtgagccatacacacagcaggattagacggggagagtttcagctgcagcttctagtttaagaccaaagcccttcctcccgctgctgcatctgtctgagaggggaagctcttgttttccaagctggaaccgtttatgaggaaaactgagcagggtggcaaaatggaaaaggaacaattttctagtttttcctacgcgtgatattgacgcgtgctttttctttgatttgaggtacagcatgtaaataacaaatttccatattcaaaatgatcatattagagtgactgagtgaccttttgattttgaagcagactaaaatctgaccagaccacaatgaaaagtataaaattagaaacttaaattccaagctaaatttcagctttgacccacctaactccagtgaataggtggcagctcagaaacaaggacagcactgctgctgccagagcaagctcacatccagctggcacttcgtgagagctccttcctgccgggcacgtgtgagttcagcgtgggcaagagacttttatgcacattctgtcattcaaaagggaaatgatgccaaccccagatgcagcatgtcctgaatgaatgatctgtaaaatacaataataaaagcttatagtttgagtagaa

SEQ ID NO: 308170 - DNA, 3496 bp, Homo sapiens
aagtgcacggaggagttccgggggccaggcggccgccgcgagtctggtatcctgagcttcgtgagttgagcgctgctgctccgcggtggagtcaccgcaccgctcccgggatcatggtgttctacttcaccagcagcagcgttaattcatctgcctacactatttacatgggaaaagataaatatgaaaatgaagatctgatcaagcatggctggcctgaagatatctgggagagaatatagaagacatcccaaaggaagtgctgatggactgtgcccaccttgtgaaggccaatagcattcaaggtaaaaattgtgacagtggagaagaaagtaaatgagatcctgaaccgattagaaaagaccaaagtcgagcggttcccagacctagcagcagagaaagaatgcagagatcgtgaagagaggaatgagaaaaaagcccaaattcaggaaatgaaaaagagagaaaaagaagaaatgaagaagaagagggaaatggatgaacttaggagctattcatcactaatgaaagttgaaaatatgtcttcaaatcaggatggcaatgattcagatgaattcatgtaaaaggagaaaaggagaaaaggacctttgaaagatgtgaatgtagagacaattgcagaccttttggtttcatctgtgttctgaagtataaaatacaaccaaaattctaccttcatcctacccagaaattattgattttcaagttttaaaaaaattgtaccttttttgctgacagaaaaggatcagatatgtataaaatagttgaacttgacagcatataacttaaagtgaaaatgtttttgccagaacatgtcttggtaccttgtgaaagcaggctgcccttgttcttgagatagactttaaaatgaaccagctctgaaaagtacttctgctgctctggtctatccctgaaaacagatgtcttgaaacacttttcatattcttaaaataatcttcacttctgttaagaagaacatgttggtgggtaattatgcgaatgtttccctgtccctgatttctcgattaggcgtatgggttttgaaaaagagatttttcagaagattgtcagcttcagtattcacgttccatcgtgtcatctgggtctgttagtgtagtgaccctcagtgcagtctgtcccagcgtttacgtccttgcttcctctgagcagaggcctccatcttagtatcaacatatttaaagaaattgatggtgttcatcaagctggggcctgtggcagttgttgcctgagcaccaagtaacccaagccacctatgtgacaacttctgggcccaggagtaatttctcagcattgagggtaaaataggatggagtgctctgttgatcatttgggagatgtaggttacctgatttgtgccttaggatgcagcgtgaagcagaagtccatattgcaattatgattttagaaggaactaagcattttactcacacccacagcagcaagaatgacctcctgcagcagatattccacctgtaatagcactttggaactgtgggcaaaaccaaaaggctagtgtttccatttattccatgttggtgtatggggttgaactggaaaattccctgaggcaaaactcactggccaaattttgagagggtatagaaaatgactttagagatgagtggttttgtgtatgtgtctgatgatattcagtctgatgttccgcaattttaaaagttataataaaataccatttttttaatctggaaggacattgatatatgaattcttagaatttgctattaaaaagggtagcccccattccacaagctggttttgagggtgatcttgctctaaaaaacctcattcatcataggctcagtctgacaggttctgtacggggctatcatctttctcctcctctgctaaatgcctctttcttccagctgctcactgggtcaaagggatgtcctttctcagatgtattcttgatacatctcagatgtattcgtagctgtgctccttccatacttccaaggagtccggcttctacagaattcctctgtacctcacactgcaacacatgtagatagcgcttttgaaaaatacatatatttttactatagtatgagaggtcctggggctcaaactttaaacatttcctaactcagcttacactggtttaaaatgtccaggtctctgctgaattctcttgttgaattcatagctctccaacctcctctgtgttgattcctatgcccctaaccctgcagcctctttgttttatttttttccccatctctgttggtcccagggaaagcaaggaaattttcttttgaggacttataggttgattgcccacaggtcaaactgttggcattgaactcctctcatttcttgccattggattgtttcctaaacgttggataggagaattcgaaattgttgctatttttatgagctgtgcccttgatcaaatctgtgctgtgggtctgagtcattttgccaatgtcgtcttcagtttcaacactctgatcagcatgcaggcgaggggcatgtttaatttacttcactaactgctatattctatagctttagacttcatatttcttatccacctttgtctaggctcacgatctttgggcaagggagctttgtcaccgtggttgggctagaacaaatattgagaagtttaccaacacagatgttgagaagtttattgaaaggcactgacattagcagaataagtgatggacattagttgaaccccttcagtgtctatgtgttttattgtattgtctttaactcgttcttgaagcacagatttcagcgagcctttcagctattcagtgccagcggttttccccactcaggaaagatggtgtgagccatacacacagcaggattagacggggagagtttcagctgcagcttctagtttaagaccaaagcccttcctcccgctgctgcatctgtctgagaggggaagctcttgttttccaagctggaaccgtttatgaggaaaactgagcagggtggcaaaatggaaaaggaacaattttctagtttttcctacgcgtgatattgacgcgtgctttttctttgatttgaggtacagcatgtaaataacaaatttccatattcaaaatgatcatattagagtgactgagtgaccttttgattttgaagcagactaaaatctgaccagaccacaatgaaaagtataaaattagaaacttaaattccaagctaaatttcagctttgacccacctaactccagtgaataggtggcagctcagaaacaaggacagcactgctgctgccagagcaagctcacatccagctggcacttcgtgagagctccttcctgccgggcacgtgtgagttcagcgtgggcaagagacttttatgcacattctgtcattcaaaagggaaatgatgccaaccccagatgcagcatgtcctgaatgaatgatctgtaaaatacaataataaaagcttatagtttgagtagaa

SEQ ID NO: 308171 - DNA, 3606 bp, Homo sapiens
aagtgcacggaggagttccgggggccaggcggccgccgcgagtctggtatcctgagcttcgtgagttgagcgctgctgctccgcggtggagtcaccgcaccgctcccgggatcatggtgttctacttcaccagcagcagcgttaattcatctgcctacactatttacatgggaaaagataaatatgaaaatgaagatctgatcaagcatggctggcctgaagatatctggtttcatgtggacaaactctcttcggctcatgtataccttcgattacataagggagagaatatagaagacatcccaaaggaagtgctgatggactgtgcccaccttgtgaaggccaatagcattcaaggctgcaagatgaacaacgttaatgtggtatatacgccgtggtctaacctgaagaaaacagctgacatggatgtggggcagataggctttcacaggcagaaggatgtaaaaattgtgacagtggagaagaaagtaaatgagatcctgaaccgattagaaaagaccaaagtcgagcggttcccagacctagcagcagagaaagaatgcagagatcgtgaagagaggaatgagaaaaaagcccaaattcaggaaatgaaaaagagagaaaaagaagaaatgaagaagaagagggaaatggatgaacttaggatggcaatgattcagatgaattcatgtaaaaggagaaaaggagaaaaggacctttgaaagatgtgaatgtagagacaattgcagaccttttggtttcatctgtgttctgaagtataaaatacaaccaaaattctaccttcatcctacccagaaattattgattttcaagttttaaaaaaattgtaccttttttgctgacagaaaaggatcagatatgtataaaatagttgaacttgacagcatataacttaaagtgaaaatgtttttgccagaacatgtcttggtaccttgtgaaagcaggctgcccttgttcttgagatagactttaaaatgaaccagctctgaaaagtacttctgctgctctggtctatccctgaaaacagatgtcttgaaacacttttcatattcttaaaataatcttcacttctgttaagaagaacatgttggtgggtaattatgcgaatgtttccctgtccctgatttctcgattaggcgtatgggttttgaaaaagagatttttcagaagattgtcagcttcagtattcacgttccatcgtgtcatctgggtctgttagtgtagtgaccctcagtgcagtctgtcccagcgtttacgtccttgcttcctctgagcagaggcctccatcttagtatcaacatatttaaagaaattgatggtgttcatcaagctggggcctgtggcagttgttgcctgagcaccaagtaacccaagccacctatgtgacaacttctgggcccaggagtaatttctcagcattgagggtaaaataggatggagtgctctgttgatcatttgggagatgtaggttacctgatttgtgccttaggatgcagcgtgaagcagaagtccatattgcaattatgattttagaaggaactaagcattttactcacacccacagcagcaagaatgacctcctgcagcagatattccacctgtaatagcactttggaactgtgggcaaaaccaaaaggctagtgtttccatttattccatgttggtgtatggggttgaactggaaaattccctgaggcaaaactcactggccaaattttgagagggtatagaaaatgactttagagatgagtggttttgtgtatgtgtctgatgatattcagtctgatgttccgcaattttaaaagttataataaaataccatttttttaatctggaaggacattgatatatgaattcttagaatttgctattaaaaagggtagcccccattccacaagctggttttgagggtgatcttgctctaaaaaacctcattcatcataggctcagtctgacaggttctgtacggggctatcatctttctcctcctctgctaaatgcctctttcttccagctgctcactgggtcaaagggatgtcctttctcagatgtattcttgatacatctcagatgtattcgtagctgtgctccttccatacttccaaggagtccggcttctacagaattcctctgtacctcacactgcaacacatgtagatagcgcttttgaaaaatacatatatttttactatagtatgagaggtcctggggctcaaactttaaacatttcctaactcagcttacactggtttaaaatgtccaggtctctgctgaattctcttgttgaattcatagctctccaacctcctctgtgttgattcctatgcccctaaccctgcagcctctttgttttatttttttccccatctctgttggtcccagggaaagcaaggaaattttcttttgaggacttataggttgattgcccacaggtcaaactgttggcattgaactcctctcatttcttgccattggattgtttcctaaacgttggataggagaattcgaaattgttgctatttttatgagctgtgcccttgatcaaatctgtgctgtgggtctgagtcattttgccaatgtcgtcttcagtttcaacactctgatcagcatgcaggcgaggggcatgtttaatttacttcactaactgctatattctatagctttagacttcatatttcttatccacctttgtctaggctcacgatctttgggcaagggagctttgtcaccgtggttgggctagaacaaatattgagaagtttaccaacacagatgttgagaagtttattgaaaggcactgacattagcagaataagtgatggacattagttgaaccccttcagtgtctatgtgttttattgtattgtctttaactcgttcttgaagcacagatttcagcgagcctttcagctattcagtgccagcggttttccccactcaggaaagatggtgtgagccatacacacagcaggattagacggggagagtttcagctgcagcttctagtttaagaccaaagcccttcctcccgctgctgcatctgtctgagaggggaagctcttgttttccaagctggaaccgtttatgaggaaaactgagcagggtggcaaaatggaaaaggaacaattttctagtttttcctacgcgtgatattgacgcgtgctttttctttgatttgaggtacagcatgtaaataacaaatttccatattcaaaatgatcatattagagtgactgagtgaccttttgattttgaagcagactaaaatctgaccagaccacaatgaaaagtataaaattagaaacttaaattccaagctaaatttcagctttgacccacctaactccagtgaataggtggcagctcagaaacaaggacagcactgctgctgccagagcaagctcacatccagctggcacttcgtgagagctccttcctgccgggcacgtgtgagttcagcgtgggcaagagacttttatgcacattctgtcattcaaaagggaaatgatgccaaccccagatgcagcatgtcctgaatgaatgatctgtaaaatacaataataaaagcttatagtttgagtagaa

SEQ ID NO: 308172 - DNA, 3548 bp, Homo sapiens
aagtgcacggaggagttccgggggccaggcggccgccgcgagtctggtatcctgagcttcgtgagttgagcgctgctgctccgcggtggagtcaccgcaccgctcccgggatcatggtgttctacttcaccagcagcagcgttaattcatctgcctacactatttacatgggaaaagataaatatgaaaatgaagatctgatcaagcatggctggcctgaagatatctggtttcatgtggacaaactctcttcggctcatgtataccttcgattacataagggagagaatatagaagacatcccaaaggaagtgctgatggactgtgcccaccttgtgaaggccaatagcattcaaggtaaaaattgtgacagtggagaagaaagtaaatgagatcctgaaccgattagaaaagaccaaagtcgagcggttcccagacctagcagcagagaaagaatgcagagatcgtgaagagaggaatgagaaaaaagcccaaattcaggaaatgaaaaagagagaaaaagaagaaatgaagaagaagagggaaatggatgaacttaggagctattcatcactaatgaaagttgaaaatatgtcttcaaatcaggatggcaatgattcagatgaattcatgtaaaaggagaaaaggagaaaaggacctttgaaagatgtgaatgtagagacaattgcagaccttttggtttcatctgtgttctgaagtataaaatacaaccaaaattctaccttcatcctacccagaaattattgattttcaagttttaaaaaaattgtaccttttttgctgacagaaaaggatcagatatgtataaaatagttgaacttgacagcatataacttaaagtgaaaatgtttttgccagaacatgtcttggtaccttgtgaaagcaggctgcccttgttcttgagatagactttaaaatgaaccagctctgaaaagtacttctgctgctctggtctatccctgaaaacagatgtcttgaaacacttttcatattcttaaaataatcttcacttctgttaagaagaacatgttggtgggtaattatgcgaatgtttccctgtccctgatttctcgattaggcgtatgggttttgaaaaagagatttttcagaagattgtcagcttcagtattcacgttccatcgtgtcatctgggtctgttagtgtagtgaccctcagtgcagtctgtcccagcgtttacgtccttgcttcctctgagcagaggcctccatcttagtatcaacatatttaaagaaattgatggtgttcatcaagctggggcctgtggcagttgttgcctgagcaccaagtaacccaagccacctatgtgacaacttctgggcccaggagtaatttctcagcattgagggtaaaataggatggagtgctctgttgatcatttgggagatgtaggttacctgatttgtgccttaggatgcagcgtgaagcagaagtccatattgcaattatgattttagaaggaactaagcattttactcacacccacagcagcaagaatgacctcctgcagcagatattccacctgtaatagcactttggaactgtgggcaaaaccaaaaggctagtgtttccatttattccatgttggtgtatggggttgaactggaaaattccctgaggcaaaactcactggccaaattttgagagggtatagaaaatgactttagagatgagtggttttgtgtatgtgtctgatgatattcagtctgatgttccgcaattttaaaagttataataaaataccatttttttaatctggaaggacattgatatatgaattcttagaatttgctattaaaaagggtagcccccattccacaagctggttttgagggtgatcttgctctaaaaaacctcattcatcataggctcagtctgacaggttctgtacggggctatcatctttctcctcctctgctaaatgcctctttcttccagctgctcactgggtcaaagggatgtcctttctcagatgtattcttgatacatctcagatgtattcgtagctgtgctccttccatacttccaaggagtccggcttctacagaattcctctgtacctcacactgcaacacatgtagatagcgcttttgaaaaatacatatatttttactatagtatgagaggtcctggggctcaaactttaaacatttcctaactcagcttacactggtttaaaatgtccaggtctctgctgaattctcttgttgaattcatagctctccaacctcctctgtgttgattcctatgcccctaaccctgcagcctctttgttttatttttttccccatctctgttggtcccagggaaagcaaggaaattttcttttgaggacttataggttgattgcccacaggtcaaactgttggcattgaactcctctcatttcttgccattggattgtttcctaaacgttggataggagaattcgaaattgttgctatttttatgagctgtgcccttgatcaaatctgtgctgtgggtctgagtcattttgccaatgtcgtcttcagtttcaacactctgatcagcatgcaggcgaggggcatgtttaatttacttcactaactgctatattctatagctttagacttcatatttcttatccacctttgtctaggctcacgatctttgggcaagggagctttgtcaccgtggttgggctagaacaaatattgagaagtttaccaacacagatgttgagaagtttattgaaaggcactgacattagcagaataagtgatggacattagttgaaccccttcagtgtctatgtgttttattgtattgtctttaactcgttcttgaagcacagatttcagcgagcctttcagctattcagtgccagcggttttccccactcaggaaagatggtgtgagccatacacacagcaggattagacggggagagtttcagctgcagcttctagtttaagaccaaagcccttcctcccgctgctgcatctgtctgagaggggaagctcttgttttccaagctggaaccgtttatgaggaaaactgagcagggtggcaaaatggaaaaggaacaattttctagtttttcctacgcgtgatattgacgcgtgctttttctttgatttgaggtacagcatgtaaataacaaatttccatattcaaaatgatcatattagagtgactgagtgaccttttgattttgaagcagactaaaatctgaccagaccacaatgaaaagtataaaattagaaacttaaattccaagctaaatttcagctttgacccacctaactccagtgaataggtggcagctcagaaacaaggacagcactgctgctgccagagcaagctcacatccagctggcacttcgtgagagctccttcctgccgggcacgtgtgagttcagcgtgggcaagagacttttatgcacattctgtcattcaaaagggaaatgatgccaaccccagatgcagcatgtcctgaatgaatgatctgtaaaatacaataataaaagcttatagtttgagtagaa

SEQ ID NO: 308173 - DNA, 3848 bp, Homo sapiens
aagtgcacggaggagttccgggggccaggcggccgccgcgagtctggtatcctgagcttcgtgagttgagcgctgctgctccgcggtggagtcaccgcaccgctcccgggatcatggtgttctacttcaccagcagcagcgttaattcatctgcctacactatttacatgggaaaagataaatatgaaagctgaggcgagaggatcacttgagcccaggagttcgagacctgcctgagcaacatagggagaccctgtctctacaaaaaacaacaataaaagaaaatattagctgggcatagtgacacacacctgttgtccttgctactctggaggctgaggcaggaagatcgcttgagcctgggaggtaggctgcagtgagctgtgatcatgccactgcattccagcttaagagacagcgagaatctgttgtctgaaatgaagatctgatcaagcatggctggcctgaagatatctgggagagaatatagaagacatcccaaaggaagtgctgatggactgtgcccaccttgtgaaggccaatagcattcaaggctgcaagatgaacaacgttaatgtggtatatacgccgtggtctaacctgaagaaaacagctgacatggatgtggggcagataggctttcacaggcagaaggatgtaaaaattgtgacagtggagaagaaagtaaatgagatcctgaaccgattagaaaagaccaaagtcgagcggttcccagacctagcagcagagaaagaatgcagagatcgtgaagagaggaatgagaaaaaagcccaaattcaggaaatgaaaaagagagaaaaagaagaaatgaagaagaagagggaaatggatgaacttaggagctattcatcactaatgaaagttgaaaatatgtcttcaaatcaggatggcaatgattcagatgaattcatgtaaaaggagaaaaggagaaaaggacctttgaaagatgtgaatgtagagacaattgcagaccttttggtttcatctgtgttctgaagtataaaatacaaccaaaattctaccttcatcctacccagaaattattgattttcaagttttaaaaaaattgtaccttttttgctgacagaaaaggatcagatatgtataaaatagttgaacttgacagcatataacttaaagtgaaaatgtttttgccagaacatgtcttggtaccttgtgaaagcaggctgcccttgttcttgagatagactttaaaatgaaccagctctgaaaagtacttctgctgctctggtctatccctgaaaacagatgtcttgaaacacttttcatattcttaaaataatcttcacttctgttaagaagaacatgttggtgggtaattatgcgaatgtttccctgtccctgatttctcgattaggcgtatgggttttgaaaaagagatttttcagaagattgtcagcttcagtattcacgttccatcgtgtcatctgggtctgttagtgtagtgaccctcagtgcagtctgtcccagcgtttacgtccttgcttcctctgagcagaggcctccatcttagtatcaacatatttaaagaaattgatggtgttcatcaagctggggcctgtggcagttgttgcctgagcaccaagtaacccaagccacctatgtgacaacttctgggcccaggagtaatttctcagcattgagggtaaaataggatggagtgctctgttgatcatttgggagatgtaggttacctgatttgtgccttaggatgcagcgtgaagcagaagtccatattgcaattatgattttagaaggaactaagcattttactcacacccacagcagcaagaatgacctcctgcagcagatattccacctgtaatagcactttggaactgtgggcaaaaccaaaaggctagtgtttccatttattccatgttggtgtatggggttgaactggaaaattccctgaggcaaaactcactggccaaattttgagagggtatagaaaatgactttagagatgagtggttttgtgtatgtgtctgatgatattcagtctgatgttccgcaattttaaaagttataataaaataccatttttttaatctggaaggacattgatatatgaattcttagaatttgctattaaaaagggtagcccccattccacaagctggttttgagggtgatcttgctctaaaaaacctcattcatcataggctcagtctgacaggttctgtacggggctatcatctttctcctcctctgctaaatgcctctttcttccagctgctcactgggtcaaagggatgtcctttctcagatgtattcttgatacatctcagatgtattcgtagctgtgctccttccatacttccaaggagtccggcttctacagaattcctctgtacctcacactgcaacacatgtagatagcgcttttgaaaaatacatatatttttactatagtatgagaggtcctggggctcaaactttaaacatttcctaactcagcttacactggtttaaaatgtccaggtctctgctgaattctcttgttgaattcatagctctccaacctcctctgtgttgattcctatgcccctaaccctgcagcctctttgttttatttttttccccatctctgttggtcccagggaaagcaaggaaattttcttttgaggacttataggttgattgcccacaggtcaaactgttggcattgaactcctctcatttcttgccattggattgtttcctaaacgttggataggagaattcgaaattgttgctatttttatgagctgtgcccttgatcaaatctgtgctgtgggtctgagtcattttgccaatgtcgtcttcagtttcaacactctgatcagcatgcaggcgaggggcatgtttaatttacttcactaactgctatattctatagctttagacttcatatttcttatccacctttgtctaggctcacgatctttgggcaagggagctttgtcaccgtggttgggctagaacaaatattgagaagtttaccaacacagatgttgagaagtttattgaaaggcactgacattagcagaataagtgatggacattagttgaaccccttcagtgtctatgtgttttattgtattgtctttaactcgttcttgaagcacagatttcagcgagcctttcagctattcagtgccagcggttttccccactcaggaaagatggtgtgagccatacacacagcaggattagacggggagagtttcagctgcagcttctagtttaagaccaaagcccttcctcccgctgctgcatctgtctgagaggggaagctcttgttttccaagctggaaccgtttatgaggaaaactgagcagggtggcaaaatggaaaaggaacaattttctagtttttcctacgcgtgatattgacgcgtgctttttctttgatttgaggtacagcatgtaaataacaaatttccatattcaaaatgatcatattagagtgactgagtgaccttttgattttgaagcagactaaaatctgaccagaccacaatgaaaagtataaaattagaaacttaaattccaagctaaatttcagctttgacccacctaactccagtgaataggtggcagctcagaaacaaggacagcactgctgctgccagagcaagctcacatccagctggcacttcgtgagagctccttcctgccgggcacgtgtgagttcagcgtgggcaagagacttttatgcacattctgtcattcaaaagggaaatgatgccaaccccagatgcagcatgtcctgaatgaatgatctgtaaaatacaataataaaagcttatagtttgagtagaa

SEQ ID NO: 308174 - DNA, 3554 bp, Homo sapiens
aagtgcacggaggagttccgggggccaggcggccgccgcgagtctggtatcctgagcttcgtgagttgagcgctgctgctccgcggtggagtcaccgcaccgctcccgggatcatggtgttctacttcaccagcagcagcgttaattcatctgcctacactatttacatgggaaaagataaatatgaaaatgaagatctgatcaagcatggctggcctgaagatatctgggagagaatatagaagacatcccaaaggaagtgctgatggactgtgcccaccttgtgaaggccaatagcattcaaggctgcaagatgaacaacgttaatgtggtatatacgccgtggtctaacctgaagaaaacagctgacatggatgtggggcagataggctttcacaggcagaaggatgtaaaaattgtgacagtggagaagaaagtaaatgagatcctgaaccgattagaaaagaccaaagtcgagcggttcccagacctagcagcagagaaagaatgcagagatcgtgaagagaggaatgagaaaaaagcccaaattcaggaaatgaaaaagagagaaaaagaagaaatgaagaagaagagggaaatggatgaacttaggatggcaatgattcagatgaattcatgtaaaaggagaaaaggagaaaaggacctttgaaagatgtgaatgtagagacaattgcagaccttttggtttcatctgtgttctgaagtataaaatacaaccaaaattctaccttcatcctacccagaaattattgattttcaagttttaaaaaaattgtaccttttttgctgacagaaaaggatcagatatgtataaaatagttgaacttgacagcatataacttaaagtgaaaatgtttttgccagaacatgtcttggtaccttgtgaaagcaggctgcccttgttcttgagatagactttaaaatgaaccagctctgaaaagtacttctgctgctctggtctatccctgaaaacagatgtcttgaaacacttttcatattcttaaaataatcttcacttctgttaagaagaacatgttggtgggtaattatgcgaatgtttccctgtccctgatttctcgattaggcgtatgggttttgaaaaagagatttttcagaagattgtcagcttcagtattcacgttccatcgtgtcatctgggtctgttagtgtagtgaccctcagtgcagtctgtcccagcgtttacgtccttgcttcctctgagcagaggcctccatcttagtatcaacatatttaaagaaattgatggtgttcatcaagctggggcctgtggcagttgttgcctgagcaccaagtaacccaagccacctatgtgacaacttctgggcccaggagtaatttctcagcattgagggtaaaataggatggagtgctctgttgatcatttgggagatgtaggttacctgatttgtgccttaggatgcagcgtgaagcagaagtccatattgcaattatgattttagaaggaactaagcattttactcacacccacagcagcaagaatgacctcctgcagcagatattccacctgtaatagcactttggaactgtgggcaaaaccaaaaggctagtgtttccatttattccatgttggtgtatggggttgaactggaaaattccctgaggcaaaactcactggccaaattttgagagggtatagaaaatgactttagagatgagtggttttgtgtatgtgtctgatgatattcagtctgatgttccgcaattttaaaagttataataaaataccatttttttaatctggaaggacattgatatatgaattcttagaatttgctattaaaaagggtagcccccattccacaagctggttttgagggtgatcttgctctaaaaaacctcattcatcataggctcagtctgacaggttctgtacggggctatcatctttctcctcctctgctaaatgcctctttcttccagctgctcactgggtcaaagggatgtcctttctcagatgtattcttgatacatctcagatgtattcgtagctgtgctccttccatacttccaaggagtccggcttctacagaattcctctgtacctcacactgcaacacatgtagatagcgcttttgaaaaatacatatatttttactatagtatgagaggtcctggggctcaaactttaaacatttcctaactcagcttacactggtttaaaatgtccaggtctctgctgaattctcttgttgaattcatagctctccaacctcctctgtgttgattcctatgcccctaaccctgcagcctctttgttttatttttttccccatctctgttggtcccagggaaagcaaggaaattttcttttgaggacttataggttgattgcccacaggtcaaactgttggcattgaactcctctcatttcttgccattggattgtttcctaaacgttggataggagaattcgaaattgttgctatttttatgagctgtgcccttgatcaaatctgtgctgtgggtctgagtcattttgccaatgtcgtcttcagtttcaacactctgatcagcatgcaggcgaggggcatgtttaatttacttcactaactgctatattctatagctttagacttcatatttcttatccacctttgtctaggctcacgatctttgggcaagggagctttgtcaccgtggttgggctagaacaaatattgagaagtttaccaacacagatgttgagaagtttattgaaaggcactgacattagcagaataagtgatggacattagttgaaccccttcagtgtctatgtgttttattgtattgtctttaactcgttcttgaagcacagatttcagcgagcctttcagctattcagtgccagcggttttccccactcaggaaagatggtgtgagccatacacacagcaggattagacggggagagtttcagctgcagcttctagtttaagaccaaagcccttcctcccgctgctgcatctgtctgagaggggaagctcttgttttccaagctggaaccgtttatgaggaaaactgagcagggtggcaaaatggaaaaggaacaattttctagtttttcctacgcgtgatattgacgcgtgctttttctttgatttgaggtacagcatgtaaataacaaatttccatattcaaaatgatcatattagagtgactgagtgaccttttgattttgaagcagactaaaatctgaccagaccacaatgaaaagtataaaattagaaacttaaattccaagctaaatttcagctttgacccacctaactccagtgaataggtggcagctcagaaacaaggacagcactgctgctgccagagcaagctcacatccagctggcacttcgtgagagctccttcctgccgggcacgtgtgagttcagcgtgggcaagagacttttatgcacattctgtcattcaaaagggaaatgatgccaaccccagatgcagcatgtcctgaatgaatgatctgtaaaatacaataataaaagcttatagtttgagtagaa

SEQ ID NO: 308175 - DNA, 3345 bp, Homo sapiens
aagtgcacggaggagttccgggggccaggcggccgccgcgagtctggtatcctgagcttcgtgagttgagcgctgctgctccgcggtggagtcaccgcaccgctcccgggatcatggtgttctacttcaccagcagcagcgttaattcatctgcctacactatttacatgggaaaagataaatatgaaaatgaagatctgatcaagcatggctggcctgaagatatctggtttcatgtggacaaactctcttcggctcatgtataccttcgattacataagggagagaatatagaagacatcccaaaggaagtgctgatggactgtgcccaccttgtgaaggccaatagcattcaaggagctattcatcactaatgaaagttgaaaatatgtcttcaaatcaggatggcaatgattcagatgaattcatgtaaaaggagaaaaggagaaaaggacctttgaaagatgtgaatgtagagacaattgcagaccttttggtttcatctgtgttctgaagtataaaatacaaccaaaattctaccttcatcctacccagaaattattgattttcaagttttaaaaaaattgtaccttttttgctgacagaaaaggatcagatatgtataaaatagttgaacttgacagcatataacttaaagtgaaaatgtttttgccagaacatgtcttggtaccttgtgaaagcaggctgcccttgttcttgagatagactttaaaatgaaccagctctgaaaagtacttctgctgctctggtctatccctgaaaacagatgtcttgaaacacttttcatattcttaaaataatcttcacttctgttaagaagaacatgttggtgggtaattatgcgaatgtttccctgtccctgatttctcgattaggcgtatgggttttgaaaaagagatttttcagaagattgtcagcttcagtattcacgttccatcgtgtcatctgggtctgttagtgtagtgaccctcagtgcagtctgtcccagcgtttacgtccttgcttcctctgagcagaggcctccatcttagtatcaacatatttaaagaaattgatggtgttcatcaagctggggcctgtggcagttgttgcctgagcaccaagtaacccaagccacctatgtgacaacttctgggcccaggagtaatttctcagcattgagggtaaaataggatggagtgctctgttgatcatttgggagatgtaggttacctgatttgtgccttaggatgcagcgtgaagcagaagtccatattgcaattatgattttagaaggaactaagcattttactcacacccacagcagcaagaatgacctcctgcagcagatattccacctgtaatagcactttggaactgtgggcaaaaccaaaaggctagtgtttccatttattccatgttggtgtatggggttgaactggaaaattccctgaggcaaaactcactggccaaattttgagagggtatagaaaatgactttagagatgagtggttttgtgtatgtgtctgatgatattcagtctgatgttccgcaattttaaaagttataataaaataccatttttttaatctggaaggacattgatatatgaattcttagaatttgctattaaaaagggtagcccccattccacaagctggttttgagggtgatcttgctctaaaaaacctcattcatcataggctcagtctgacaggttctgtacggggctatcatctttctcctcctctgctaaatgcctctttcttccagctgctcactgggtcaaagggatgtcctttctcagatgtattcttgatacatctcagatgtattcgtagctgtgctccttccatacttccaaggagtccggcttctacagaattcctctgtacctcacactgcaacacatgtagatagcgcttttgaaaaatacatatatttttactatagtatgagaggtcctggggctcaaactttaaacatttcctaactcagcttacactggtttaaaatgtccaggtctctgctgaattctcttgttgaattcatagctctccaacctcctctgtgttgattcctatgcccctaaccctgcagcctctttgttttatttttttccccatctctgttggtcccagggaaagcaaggaaattttcttttgaggacttataggttgattgcccacaggtcaaactgttggcattgaactcctctcatttcttgccattggattgtttcctaaacgttggataggagaattcgaaattgttgctatttttatgagctgtgcccttgatcaaatctgtgctgtgggtctgagtcattttgccaatgtcgtcttcagtttcaacactctgatcagcatgcaggcgaggggcatgtttaatttacttcactaactgctatattctatagctttagacttcatatttcttatccacctttgtctaggctcacgatctttgggcaagggagctttgtcaccgtggttgggctagaacaaatattgagaagtttaccaacacagatgttgagaagtttattgaaaggcactgacattagcagaataagtgatggacattagttgaaccccttcagtgtctatgtgttttattgtattgtctttaactcgttcttgaagcacagatttcagcgagcctttcagctattcagtgccagcggttttccccactcaggaaagatggtgtgagccatacacacagcaggattagacggggagagtttcagctgcagcttctagtttaagaccaaagcccttcctcccgctgctgcatctgtctgagaggggaagctcttgttttccaagctggaaccgtttatgaggaaaactgagcagggtggcaaaatggaaaaggaacaattttctagtttttcctacgcgtgatattgacgcgtgctttttctttgatttgaggtacagcatgtaaataacaaatttccatattcaaaatgatcatattagagtgactgagtgaccttttgattttgaagcagactaaaatctgaccagaccacaatgaaaagtataaaattagaaacttaaattccaagctaaatttcagctttgacccacctaactccagtgaataggtggcagctcagaaacaaggacagcactgctgctgccagagcaagctcacatccagctggcacttcgtgagagctccttcctgccgggcacgtgtgagttcagcgtgggcaagagacttttatgcacattctgtcattcaaaagggaaatgatgccaaccccagatgcagcatgtcctgaatgaatgatctgtaaaatacaataataaaagcttatagtttgagtagaa

SEQ ID NO: 308176 - DNA, 3024 bp, Homo sapiens
cttggggtggagagaagtggattattgtttttctaggagctattcatcactaatgaaagttgaaaatatgtcttcaaatcaggatggcaatgattcagatgaattcatgtaaaaggagaaaaggagaaaaggacctttgaaagatgtgaatgtagagacaattgcagaccttttggtttcatctgtgttctgaagtataaaatacaaccaaaattctaccttcatcctacccagaaattattgattttcaagttttaaaaaaattgtaccttttttgctgacagaaaaggatcagatatgtataaaatagttgaacttgacagcatataacttaaagtgaaaatgtttttgccagaacatgtcttggtaccttgtgaaagcaggctgcccttgttcttgagatagactttaaaatgaaccagctctgaaaagtacttctgctgctctggtctatccctgaaaacagatgtcttgaaacacttttcatattcttaaaataatcttcacttctgttaagaagaacatgttggtgggtaattatgcgaatgtttccctgtccctgatttctcgattaggcgtatgggttttgaaaaagagatttttcagaagattgtcagcttcagtattcacgttccatcgtgtcatctgggtctgttagtgtagtgaccctcagtgcagtctgtcccagcgtttacgtccttgcttcctctgagcagaggcctccatcttagtatcaacatatttaaagaaattgatggtgttcatcaagctggggcctgtggcagttgttgcctgagcaccaagtaacccaagccacctatgtgacaacttctgggcccaggagtaatttctcagcattgagggtaaaataggatggagtgctctgttgatcatttgggagatgtaggttacctgatttgtgccttaggatgcagcgtgaagcagaagtccatattgcaattatgattttagaaggaactaagcattttactcacacccacagcagcaagaatgacctcctgcagcagatattccacctgtaatagcactttggaactgtgggcaaaaccaaaaggctagtgtttccatttattccatgttggtgtatggggttgaactggaaaattccctgaggcaaaactcactggccaaattttgagagggtatagaaaatgactttagagatgagtggttttgtgtatgtgtctgatgatattcagtctgatgttccgcaattttaaaagttataataaaataccatttttttaatctggaaggacattgatatatgaattcttagaatttgctattaaaaagggtagcccccattccacaagctggttttgagggtgatcttgctctaaaaaacctcattcatcataggctcagtctgacaggttctgtacggggctatcatctttctcctcctctgctaaatgcctctttcttccagctgctcactgggtcaaagggatgtcctttctcagatgtattcttgatacatctcagatgtattcgtagctgtgctccttccatacttccaaggagtccggcttctacagaattcctctgtacctcacactgcaacacatgtagatagcgcttttgaaaaatacatatatttttactatagtatgagaggtcctggggctcaaactttaaacatttcctaactcagcttacactggtttaaaatgtccaggtctctgctgaattctcttgttgaattcatagctctccaacctcctctgtgttgattcctatgcccctaaccctgcagcctctttgttttatttttttccccatctctgttggtcccagggaaagcaaggaaattttcttttgaggacttataggttgattgcccacaggtcaaactgttggcattgaactcctctcatttcttgccattggattgtttcctaaacgttggataggagaattcgaaattgttgctatttttatgagctgtgcccttgatcaaatctgtgctgtgggtctgagtcattttgccaatgtcgtcttcagtttcaacactctgatcagcatgcaggcgaggggcatgtttaatttacttcactaactgctatattctatagctttagacttcatatttcttatccacctttgtctaggctcacgatctttgggcaagggagctttgtcaccgtggttgggctagaacaaatattgagaagtttaccaacacagatgttgagaagtttattgaaaggcactgacattagcagaataagtgatggacattagttgaaccccttcagtgtctatgtgttttattgtattgtctttaactcgttcttgaagcacagatttcagcgagcctttcagctattcagtgccagcggttttccccactcaggaaagatggtgtgagccatacacacagcaggattagacggggagagtttcagctgcagcttctagtttaagaccaaagcccttcctcccgctgctgcatctgtctgagaggggaagctcttgttttccaagctggaaccgtttatgaggaaaactgagcagggtggcaaaatggaaaaggaacaattttctagtttttcctacgcgtgatattgacgcgtgctttttctttgatttgaggtacagcatgtaaataacaaatttccatattcaaaatgatcatattagagtgactgagtgaccttttgattttgaagcagactaaaatctgaccagaccacaatgaaaagtataaaattagaaacttaaattccaagctaaatttcagctttgacccacctaactccagtgaataggtggcagctcagaaacaaggacagcactgctgctgccagagcaagctcacatccagctggcacttcgtgagagctccttcctgccgggcacgtgtgagttcagcgtgggcaagagacttttatgcacattctgtcattcaaaagggaaatgatgccaaccccagatgcagcatgtcctgaatgaatgatctgtaaaatacaataataaaagcttatagtttgagtagaa

SEQ ID NO: 308177 - DNA, 3598 bp, Homo sapiens
aagtgcacggaggagttccgggggccaggcggccgccgcgagtctggtatcctgagcttcgtgagttgagcgctgctgctccgcggtggagtcaccgcaccgctcccgggatcatggtgttctacttcaccagcagcagcgttaattcatctgcctacactatttacatgggaaaagataaatatgaaaatgaagatctgatcaagcatggctggcctgaagatatctggtttcatgtggacaaactctcttcggctcatgtataccttcgattacataagggagagaatatagaagacatcccaaaggaagtgctgatggactgtgcccaccttgtgaaggccaatagcattcaaggctgcaagatgaacaacgttaatgtggtatatacgccgtggtctaacctgaagaaaacagctgacatggatgtggggcagataggctttcacaggcagaaggatgtaaaaattgtgacagtggagaagaaagtaaatgagatcctgaaccgattagaaaagaccaaagtcgagcggttcccagacctagcagcagagaaagaatgcagagatcgtgaagagaggaatgagaaaaaagcccaaattcaggaaatgaaaaagagagaaaaagaagaaatgaagaagaagagggaaatggatgaacttaggagctattcatcactaatgaaagttgaaaatatgtcttcaaatcaggatggcaatgattcagatgaattcatgtaaaaggagaaaaggagaaaaggacctttgaaagatgtgaatgtagagacaattgcagaccttttggtttcatctgtgttctgaagtataaaatacaaccaaaattctaccttcatcctacccagaaattattgattttcaagttttaaaaaaattgtaccttttttgctgacagaaaaggatcagatatgtataaaatagttgaacttgacagcatataacttaaagtgaaaatgtttttgccagaacatgtcttggtaccttgtgaaagcaggctgcccttgttcttgagatagactttaaaatgaaccagctctgaaaagtacttctgctgctctggtctatccctgaaaacagatgtcttgaaacacttttcatattcttaaaataatcttcacttctgttaagaagaacatgttggtgggtaattatgcgaatgtttccctgtccctgatttctcgattaggcgtatgggttttgaaaaagagatttttcagaagattgtcagcttcagtattcacgttccatcgtgtcatctgggtctgttagtgtagtgaccctcagtgcagtctgtcccagcgtttacgtccttgcttcctctgagcagaggcctccatcttagtatcaacatatttaaagaaattgatggtgttcatcaagctggggcctgtggcagttgttgcctgagcaccaagtaacccaagccacctatgtgacaacttctgggcccaggagtaatttctcagcattgaggttgtgccttaggatgcagcgtgaagcagaagtccatattgcaattatgattttagaaggaactaagcattttactcacacccacagcagcaagaatgacctcctgcagcagatattccacctgtaatagcactttggaactgtgggcaaaaccaaaaggctagtgtttccatttattccatgttggtgtatggggttgaactggaaaattccctgaggcaaaactcactggccaaattttgagagggtatagaaaatgactttagagatgagtggttttgtgtatgtgtctgatgatattcagtctgatgttccgcaattttaaaagttataataaaataccatttttttaatctggaaggacattgatatatgaattcttagaatttgctattaaaaagggtagcccccattccacaagctggttttgagggtgatcttgctctaaaaaacctcattcatcataggctcagtctgacaggttctgtacggggctatcatctttctcctcctctgctaaatgcctctttcttccagctgctcactgggtcaaagggatgtcctttctcagatgtattcttgatacatctcagatgtattcgtagctgtgctccttccatacttccaaggagtccggcttctacagaattcctctgtacctcacactgcaacacatgtagatagcgcttttgaaaaatacatatatttttactatagtatgagaggtcctggggctcaaactttaaacatttcctaactcagcttacactggtttaaaatgtccaggtctctgctgaattctcttgttgaattcatagctctccaacctcctctgtgttgattcctatgcccctaaccctgcagcctctttgttttatttttttccccatctctgttggtcccagggaaagcaaggaaattttcttttgaggacttataggttgattgcccacaggtcaaactgttggcattgaactcctctcatttcttgccattggattgtttcctaaacgttggataggagaattcgaaattgttgctatttttatgagctgtgcccttgatcaaatctgtgctgtgggtctgagtcattttgccaatgtcgtcttcagtttcaacactctgatcagcatgcaggcgaggggcatgtttaatttacttcactaactgctatattctatagctttagacttcatatttcttatccacctttgtctaggctcacgatctttgggcaagggagctttgtcaccgtggttgggctagaacaaatattgagaagtttaccaacacagatgttgagaagtttattgaaaggcactgacattagcagaataagtgatggacattagttgaaccccttcagtgtctatgtgttttattgtattgtctttaactcgttcttgaagcacagatttcagcgagcctttcagctattcagtgccagcggttttccccactcaggaaagatggtgtgagccatacacacagcaggattagacggggagagtttcagctgcagcttctagtttaagaccaaagcccttcctcccgctgctgcatctgtctgagaggggaagctcttgttttccaagctggaaccgtttatgaggaaaactgagcagggtggcaaaatggaaaaggaacaattttctagtttttcctacgcgtgatattgacgcgtgctttttctttgatttgaggtacagcatgtaaataacaaatttccatattcaaaatgatcatattagagtgactgagtgaccttttgattttgaagcagactaaaatctgaccagaccacaatgaaaagtataaaattagaaacttaaattccaagctaaatttcagctttgacccacctaactccagtgaataggtggcagctcagaaacaaggacagcactgctgctgccagagcaagctcacatccagctggcacttcgtgagagctccttcctgccgggcacgtgtgagttcagcgtgggcaagagacttttatgcacattctgtcattcaaaagggaaatgatgccaaccccagatgcagcatgtcctgaatgaatgatctgtaaaatacaataataaaagcttatagtttgagtagaa

SEQ ID NO: 308178 - DNA, 1987 bp, Homo sapiens
gcggccgcctactactactactactgctcgaattcaagcttctaacgatgtacggggacatgttggtgtatggggttgaactggaaaattccctgaggcaaaactcactggccaaattttgagagggtatagaaaatgactttagagatgagtggttttgtgtatgtgtctgatgatattcagtctgatgttccgcaattttaaaagttataataaaataccatttttttaatctggaaggacattgatatatgaattcttagaatttgctattaaaaagggtagcccccattccacaagctggttttgagggtgatcttgctctaaaaaacctcattcatcataggctcagtctgacaggttctgtacggggctatcatctttctcctcctctgctaaatgcctctttcttccagctgctcactgggtcaaagggatgtcctttctcagatgtattcttgatacatctcagatgtattcgtagctgtgctccttccatacttccaaggagtccggcttctacagaattcctctgtacctcacactgcaacacatgtagatagcgcttttgaaaaatacatatatttttactatagtatgagaggtcctggggctcaaactttaaacatttcctaactcagcttacactggtttaaaatgtccaggtctctgctgaattctcttgttgaattcatagctctccaacctcctctgtgttgattcctatgcccctaaccctgcagcctctttgttttatttttttccccatctctgttggtcccagggaaagcaaggaaattttcttttgaggacttataggttgattgcccacaggtcaaactgttggcattgaactcctctcatttcttgccattggattgtttcctaaacgttggataggagaattcgaaattgttgctatttttatgagctgtgcccttgatcaaatctgtgctgtgggtctgagtcattttgccaatgtcgtcttcagtttcaacactctgatcagcatgcaggcgaggggcatgtttaatttacttcactaactgctatattctatagctttagacttcatatttcttatccacctttgtctaggctcacgatctttgggcaagggagctttgtcaccgtggttgggctagaacaaatattgagaagtttaccaacacagatgttgagaagtttattgaaaggcactgacattagcagaataagtgatggacattagttgaaccccttcagtgtctatgtgttttattgtattgtctttaactcgttcttgaagcacagatttcagcgagcctttcagctattcagtgccagcggttttccccactcaggaaagatggtgtgagccatacacacagcaggattagacggggagagtttcagctgcagcttctagtttaagaccaaagcccttcctcccgctgctgcatctgtctgagaggggaagctcttgttttccaagctggaaccgtttatgaggaaaactgagcagggtggcaaaatggaaaaggaacaattttctagtttttcctacgcgtgatattgacgcgtgctttttctttgatttgaggtacagcatgtaaataacaaatttccatattcaaaatgatcatattagagtgactgagtgaccttttgattttgaagcagactaaaatctgaccagaccacaatgaaaagtataaaattagaaacttaaattccaagctaaatttcagctttgacccacctaactccagtgaataggtggcagctcagaaacaaggacagcactgctgctgccagagcaagctcacatccagctggcacttcgtgagagctccttcctgccgggcacgtgtgagttcagcgtgggcaagagacttttatgcacattctgtcattcaaaagggaaatgatgccaaccccagatgcagcatgtcctgaatgaatgatctgtaaaatacaataataaaagcttatagtttgagtagaa

SEQ ID NO: 308179 - DNA, 806 bp, Homo sapiens
aagtgcacggaggagttccgggggccaggcggccgccgcgagtctggtatcctgagcttcgtgagttgagcgctgctgctccgcggtggagtcaccgcaccgctcccgggatcatggtgttctacttcaccagcagcagcgttaattcatctgcctacactatttacatgggaaaagataaatatgaaaatgaagatctgatcaagcatggctggcctgaagatatctggtttcatgtggacaaactctcttcggctcatgtataccttcgattacataagggagagaatatagaagacatcccaaaggaagtgctgatggactgtgcccaccttgtgaaggccaatagcattcaaggtaaaaattgtgacagtggagaagaaagtaaatgagatcctgaaccgattagaaaagaccaaagtcgagcggttcccagacctagcagcagagaaagaatgcagagatcgtgaagagaggaatgagaaaaaagcccaaattcaggaaatgaaaaagagagaaaaagaagaaatgaagaagaagagggaaatggatgaacttaggtatgtcggagctgtggcattgagactgacctcaaagattattccctgatgattttaatcatgtattagccattaagaacgatatattggtggaaggagggacatgtaacaagctcagcttaagctcaaccttaaatcagttttttaaaaaaaaggcatttatattaatgtggttgggttaaaagaattgcttgtttatggcagcagggatatgaaagtggatgaaataaaataactaattttatt

SEQ ID NO: 308180 - DNA, 198 bp, Homo sapiens
catggctggcctgaagatatctggtaagtaacaattttggttctgccctctgtagatcatcatttcctttcttagacttggccaagcattcaaactagaatcatgctttgtactgtggtttatgggtcttcagggttaaacagctgactgccagttccttcatttctaattaccttgcaagttggaaatgatgttttt

SEQ ID NO: 308181 - DNA, 519 bp, Homo sapiens
acttattaagtgtcaatattttcatattacagccttctcttattttaaacaaacattcccgtaatgcacacagtaaatttacttttcagtgttctgtaacagttgaagaacctctgcttttagtaaaatcatgcctagtaggtaaggcagcaaatgccctttgagtgctccagtgtcaatggataatgaggtagtggaccaattggtttatttttgtgtttcagggagagaatatagaagacatcccaaaggaagtgctgatggactgtgcccaccttgtgaaggccaatagcattcaaggtcagttttcctagaggtgtttttagaattagcacggactttctctgtgtctgaaatggattacattttagtgagcatgctgttgactttggcctccatcaaagaataacatgtgctgtgcctttgccatgttttgttctttaagatggatggcaattttggtacctgtcaaagaactaaaaactgatctccccacccttgtcattttgaccgtcctgt

SEQ ID NO: 308182 - DNA, 2581 bp, Homo sapiens
caggggcggaggcggcggccagggaggaagcggaggaggcggaggcggccgcggcgttcgcccgcccgctcgctcgctcggtttccccgcccccgccgggcttaacgccgctgaaggtatccgggtgcgcgctgtcgcaacctgccctcatcctggcccgcgactgtaagaccggacccacatccagaccaatcttcctgtccgggctgctgcgacgcgggctccgcaggttgcaggcgggcggccggggcgcctgaaggttaccgagtgcatgagcgcctagcgcttcccgcgctgccccgcccgctggcccgccgacccgcccgccggctcgcccgccagcccctcggcgcccggcggcggcggcggcggtggcggcgacggtcgcaggaggtgccgtctgcctcccaggtgcgcgcttcgctcccggagccgcggaactcggcggccgccatggcgtccaacatggaccgggagatgatcctggcggattttcaggcatgtactggcattgaaaacattgacgaagctattacattgcttgaacaaaataattgggacttagtggcagctatcaatggtgtaataccacaggaaaatggcattctacaaagtgaatatggaggtgagaccataccaggacctgcatttaatccagcaagtcatccagcttcagctcctacttcctcttcttcttcagcgtttcgacctgtaatgccatccaggcagattgtagaaaggcaacctcggatgctggacttcagggttgaatacagagacagaaatgttgatgtggtacttgaagacacctgtactgttggagagattaaacagattctagaaaatgaacttcagatacctgtgtccaaaatgctgttaaaaggctggaagacgggagatgtggaagacagtacggtcctaaaatctctacacttgccaaaaaacaacagtctttatgtccttacaccagatttgccaccaccttcatcatctagtcatgctggtgccctgcaggagtcattaaatcaaaacttcatgctgatcatcacccaccgagaagtccagcgggagtacaacctgaacttctcaggaagcagtactattcaagaggtaaagagaaatgtgtatgaccttacaagtatccccgttcgccaccaattatgggagggctggccaacttctgctacagacgactcaatgtgtcttgctgaatcagggctctcttatccctgccatcgacttacagtgggaagaagatcttcacctgcacagacccgggaacagtcggaagaacaaatcaccgatgttcatatggttagtgatagcgatggagatgactttgaagatgctacagaatttggggtggatgatggagaagtatttggcatggcgtcatctgccttgagaaaatctccaatgatgccagaaaacgcagaaaatgaaggagatgccttattacaatttacagcagagttttcttcaagatatggtgattgccatcctgtattttttattggctcattagaagctgcttttcaagaggccttctatgtgaaagcccgagatagaaagcttcttgctatctacctccaccatgatgaaagtgtgttaaccaacgtgttctgctcacaaatgctttgtgctgaatccattgtttcttatctgagtcaaaattttataacctgggcttgggatctgacaaaggactccaacagagcaagatttctcactatgtgcaatagacactttggcagtgttgtggcacaaaccattcggactcaaaaaacggatcagtttccgcttttcctgattattatgggaaagcgatcatctaatgaagtgttgaatgtgatacaagggaacacaacagtagatgagttaatgatgagactcatggctgcaatggagatcttcacagcccaacaacaggaagatataaaggacgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctacttaagatttccca

SEQ ID NO: 308183 - DNA, 906 bp, Homo sapiens
  misc_feature (11)..(11): n is a, c, g, or t
  misc_feature (18)..(19): n is a, c, g, or t
  misc_feature (22)..(22): n is a, c, g, or t
  misc_feature (32)..(32): n is a, c, g, or t
ttttttggccntaaaaannccnccggaagggntccaacagagcaagatttctcactatgtgcaatagacactttggcagtgttgtggcacaaaccattcggactcaaaaaacggatcagtttccgcttttcctgattattatgggaaagcgatcatctaatgaagtgttgaatgtgatacaagggaacacaacagtagatgagttaatgatgagactcatggctgcaatggagatcttcacagcccaacaacaggaagatataaaggacgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctacttaagatttccca

SEQ ID NO: 308184 - DNA, 526 bp, Homo sapiens
ttttctttatctccaccgccattattatctccaaatacacaacatgatctagccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctacttaagatttccca

SEQ ID NO: 308185 - DNA, 568 bp, Homo sapiens
cagtcagttgttaaccagcacctttcccaagggccccctgttctgccagccaggctgagctgtgcaagaaaggtacctccaccaaacttgactatgagatttgattttcctgagccctggtttcctcatttataaaatgagaataacaacacctgccttgcaggttattttgaagatcaactaagatactgcgagactcttcgtgccagtgcatagtttcagaatcagtgtgcatagataaaatgaaggccatgtagagaatatagtgcttgtttcagtcttttgaatatgtgttcttcatctttttaggtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctacttaagatttccca

SEQ ID NO: 308186 - DNA, 334 bp, Homo sapiens
  misc_feature (11)..(12): n is a, c, g, or t
  misc_feature (17)..(17): n is a, c, g, or t
taagtggaganngtganaggtgataaagggaaaagaattaatgaggaattgtatatttaaaggagagagaccttggtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctacttaagatttccca

SEQ ID NO: 308187 - DNA, 316 bp, Homo sapiens
  misc_feature (10)..(10): n is a, c, g, or t
  misc_feature (35)..(35): n is a, c, g, or t
cccccgcccnagtaaaaaaactcatcgaaacacancaagcacgctaattaaagtcaggtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctacttaagatttccca

SEQ ID NO: 308188 - DNA, 319 bp, Homo sapiens
  misc_feature (46)..(47): n is a, c, g, or t
aaaagacgaatccaggcgcgtgtggcggtacatgggcgggcgcgcnnccagaccccttaggtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctacttaagatttccca

SEQ ID NO: 308189 - DNA, 314 bp, Homo sapiens
  misc_feature (43)..(45): n is a, c, g, or t
tgtaaggcgaaattttttttttgtgttatattatttattttgnnnatattattcggtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctacttaagatttccca

SEQ ID NO: 308190 - DNA, 874 bp, Homo sapiens
tcaattcattcttagctaccacttgccatagcgattgacacccctggccaagcgcaaggatgccctgcaggagtcattaaatcaaaacttcatgctgatcatcacccaccgagaagtccagcgggagtacaacctgaacttctcaggaagcagtactattcaagaggtaaagagaaatgtgtatgaccttacaagtatccccgttcgccaccaattatgggagggctggccaacttctgctacagacgactcaatgtgtcttgctgaatcagggctctcttatccctgccatcgacttacagtgggaagaagatcttcacctgcacagacccgggaacagtcggaagaacaaatcaccgatgttcatatggttagtgatagcgatggagatgactttgaagatgctacagaatttggggtggatgatggagaagtatttggcatggcgtcatctgccttgagaaaatctccaatgaatgatgcagaaaagcaagacaatgaaaggagatgcctataaaattacagcagagttactacaaagatatgagagaagacatcctgtattaaaatggcttcatagaagcggcaacaagaggccgtctaagtgaacagcccgagatagaacgcactagcgcaactagctcaacaagatgaagtgtgtaacaaaggtacgtcacaaatgctggctgaatccatggtcctcaattgagtcaacaattactaaccggcctgggaatcgacaacggacacaaccgagcagagctcactacgtgccaagacacttggcagagtggagcacaaccaaggacgaagcaaggatcaggaccgcagagcagagaaaagggaagggacacaaagaaggtgaaggaaagag

SEQ ID NO: 308191 - DNA, 382 bp, Homo sapiens
  misc_feature (22)..(22): n is a, c, g, or t
  misc_feature (50)..(50): n is a, c, g, or t
  misc_feature (53)..(53): n is a, c, g, or t
  misc_feature (57)..(57): n is a, c, g, or t
agaaaggataaaaggggagggnttgtttggaattgtatttaaattaatanatntatntttcgtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctacttaagatttcccacccatccatgagtatatattcccaacccttattacagagaattacaactctgccaccctccc

SEQ ID NO: 308192 - DNA, 902 bp, Homo sapiens
cattttgaggccacttttgaaatagaaccaatatttttgccatttcagaaaaattgtcgtctgtgtgccaaagacagagagcatgcagtaaaagtgcaccatagcatggatgttggactcaagcagggctcacttactaggcaggtgacttgttcctgaaaaccagtctggctgtgaacatcatccagatcctcacctcagcaaaatcacagtctgtcattaactgaagcaaatgaaaattctaaactttatgagggcataatactcagcaaagaacacaaatcctaacagtatagtttgaatttgcacaacatgaacacatccatataaacaactctttggttaaaagaacagaatatgtaacgagtagaaaaaagaaaaagaggagattagggcacatagagacacaaggaagaacaatgtgaacacagggaggagacagccatcaacaagccaagaagagaggccccagaagacacgcaaactgctgacaccttgatattggatttctagtctcagaattgcatgtactggcattgaaaacattgacgaagctattacattgcttgaacaaaataattgggacttagtggcagctatcaatggtgtaataccacaggaaaatggcattctacaaagtgaatatggaggtgagaccataccaggacctgcatttaatccagcaagtcatccagcttcagctcctacttcctcttcttcttcagcgtttcgacctgtaatgccatccaggcagattgtagaaaggcaacctcggatgctggacttcagggttgaatacagagacagaaatgttgatgtggtacttgaagacacctgtactgttggtaaggtttttcctgccataaagccttcacaaataaataattaggtaaacattcagg

SEQ ID NO: 308193 - DNA, 184 bp, Homo sapiens
ggccctcttcccctcccacttccaacctcgtgggtttccggtgccacaagggagtcttcttcccagcgtttgaacgctgcagtggtgtgtcatttaggcttttatacggtgcgtggcgtgtgtgtgtgtgtgtggcgagctatggagaagcgtataatttatatgctatcatgagtgtgtagaa

SEQ ID NO: 308194 - DNA, 2527 bp, Homo sapiens
caggggcggaggcggcggccagggaggaagcggaggaggcggaggcggccgcggcgttcgcccgcccgctcgctcgctcggtttccccgcccccgccgggcttaacgccgctgaaggtatccgggtgcgcgctgtcgcaacctgccctcatcctggcccgcgactgtaagaccggacccacatccagaccaatcttcctgtccgggctgctgcgacgcgggctccgcaggttgcaggcgggcggccggggcgcctgaaggttaccgagtgcatgagcgcctagcgcttcccgcgctgccccgccggcggcggcggcggtggcggcgacggtcgcaggaggtgccgtctgcctcccaggtgcgcgcttcgctcccggagccgcggaactcggcggccgccatggcgtccaacatggaccgggagatgatcctggcggattttcaggcatgtactggcattgaaaacattgacgaagctattacattgcttgaacaaaataattgggacttagtggcagctatcaatggtgtaataccacaggaaaatggcattctacaaagtgaatatggaggtgagaccataccaggacctgcatttaatccagcaagtcatccagcttcagctcctacttcctcttcttcttcagcgtttcgacctgtaatgccatccaggcagattgtagaaaggcaacctcggatgctggacttcagggttgaatacagagacagaaatgttgatgtggtacttgaagacacctgtactgttggagagattaaacagattctagaaaatgaacttcagatacctgtgtccaaaatgctgttaaaaggctggaagacgggagatgtggaagacagtacggtcctaaaatctctacacttgccaaaaaacaacagtctttatgtccttacaccagatttgccaccaccttcatcatctagtcatgctggtgccctgcaggagtcattaaatcaaaacttcatgctgatcatcacccaccgagaagtccagcgggagtacaacctgaacttctcaggaagcagtactattcaagaggtaaagagaaatgtgtatgaccttacaagtatccccgttcgccaccaattatgggagggctggccaacttctgctacagacgactcaatgtgtcttgctgaatcagggctctcttatccctgccatcgacttacagtgggaagaagatcttcacctgcacagacccgggaacagtcggaagaacaaatcaccgatgttcatatggttagtgatagcgatggagatgactttgaagatgctacagaatttggggtggatgatggagaagtatttggcatggcgtcatctgccttgagaaaatctccaatgatgccagaaaacgcagaaaatgaaggagatgccttattacaatttacagcagagttttcttcaagatatggtgattgccatcctgtattttttattggctcattagaagctgcttttcaagaggccttctatgtgaaagcccgagatagaaagcttcttgctatctacctccaccatgatgaaagtgtgttaaccaacgtgttctgctcacaaatgctttgtgctgaatccattgtttcttatctgagtcaaaattttataacctgggcttgggatctgacaaaggactccaacagagcaagatttctcactatgtgcaatagacactttggcagtgttgtggcacaaaccattcggactcaaaaaacggatcagtttccgcttttcctgattattatgggaaagcgatcatctaatgaagtgttgaatgtgatacaagggaacacaacagtagatgagttaatgatgagactcatggctgcaatggagatcttcacagcccaacaacaggaagatataaaggacgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctacttaagatttccca

SEQ ID NO: 308195 - DNA, 2167 bp, Homo sapiens
ggccctcttcccctcccacttccaacctcgtgggtttccggtgccacaagggagtcttcttcccagcgtttgaacgctgcagtggcatgtactggcattgaaaacattgacgaagctattacattgcttgaacaaaataattgggacttagtggcagctatcaatggtgtaataccacaggaaaatggcattctacaaagtgaatatggaggtgagaccataccaggacctgcatttaatccagcaagtcatccagcttcagctcctacttcctcttcttcttcagcgtttcgacctgtaatgccatccaggcagattgtagaaaggcaacctcggatgctggacttcagggttgaatacagagacagaaatgttgatgtggtacttgaagacacctgtactgttggagagattaaacagattctagaaaatgaacttcagatacctgtgtccaaaatgctgttaaaaggctggaagacgggagatgtggaagacagtacggtcctaaaatctctacacttgccaaaaaacaacagtctttatgtccttacaccagatttgccaccaccttcatcatctagtcatgctggtgccctgcaggagtcattaaatcaaaacttcatgctgatcatcacccaccgagaagtccagcgggagtacaacctgaacttctcaggaagcagtactattcaagaggtaaagagaaatgtgtatgaccttacaagtatccccgttcgccaccaattatgggagggctggccaacttctgctacagacgactcaatgtgtcttgctgaatcagggctctcttatccctgccatcgacttacagtgggaagaagatcttcacctgcacagacccgggaacagtcggaagaacaaatcaccgatgttcatatggttagtgatagcgatggagatgactttgaagatgctacagaatttggggtggatgatggagaagtatttggcatggcgtcatctgccttgagaaaatctccaatgatgccagaaaacgcagaaaatgaaggagatgccttattacaatttacagcagagttttcttcaagatatggtgattgccatcctgtattttttattggctcattagaagctgcttttcaagaggccttctatgtgaaagcccgagatagaaagcttcttgctatctacctccaccatgatgaaagtgtgttaaccaacgtgttctgctcacaaatgctttgtgctgaatccattgtttcttatctgagtcaaaattttataacctgggcttgggatctgacaaaggactccaacagagcaagatttctcactatgtgcaatagacactttggcagtgttgtggcacaaaccattcggactcaaaaaacggatcagtttccgcttttcctgattattatgggaaagcgatcatctaatgaagtgttgaatgtgatacaagggaacacaacagtagatgagttaatgatgagactcatggctgcaatggagatcttcacagcccaacaacaggaagatataaaggacgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctacttaagatttccca

SEQ ID NO: 308196 - DNA, 2606 bp, Homo sapiens
cattttgaggccacttttgaaatagaaccaatatttttgccatttcagaaaaattgtcgtctgtgtgccaaagacagagagcatgcagtaaaagtgcaccatagcatggatgttggactcaagcagggctcacttactaggcaggtgacttgttcctgaaaaccagtctggctgtgaacatcatccagatcctcacctcagcaaaatcacagtctgtcattaactgaagcaaatgaaaattctaaactttatgagggcataatactcagcaaagaacacaaatcctaacagtatagtttgaatttgcacaacatgaacacatccatataaacaactctttggttaaaagaacagaatatgtaacgagtagaaaaaagaaaaagaggagattagggcacatagagacacaaggaagaacaatgtgaacacagggaggagacagccatcaacaagccaagaagagaggccccagaagacacgcaaactgctgacaccttgatattggatttctagtctcagaattgcatgtactggcattgaaaacattgacgaagctattacattgcttgaacaaaataattgggacttagtggcagctatcaatggtgtaataccacaggaaaatggcattctacaaagtgaatatggaggtgagaccataccaggacctgcatttaatccagcaagtcatccagcttcagctcctacttcctcttcttcttcagcgtttcgacctgtaatgccatccaggcagattgtagaaaggcaacctcggatgctggacttcagggttgaatacagagacagaaatgttgatgtggtacttgaagacacctgtactgttggagagattaaacagattctagaaaatgaacttcagatacctgtgtccaaaatgctgttaaaaggctggaagacgggagatgtggaagacagtacggtcctaaaatctctacacttgccaaaaaacaacagtctttatgtccttacaccagatttgccaccaccttcatcatctagtcatgctggtgccctgcaggagtcattaaatcaaaacttcatgctgatcatcacccaccgagaagtccagcgggagtacaacctgaacttctcaggaagcagtactattcaagaggtaaagagaaatgtgtatgaccttacaagtatccccgttcgccaccaattatgggagggctggccaacttctgctacagacgactcaatgtgtcttgctgaatcagggctctcttatccctgccatcgacttacagtgggaagaagatcttcacctgcacagacccgggaacagtcggaagaacaaatcaccgatgttcatatggttagtgatagcgatggagatgactttgaagatgctacagaatttggggtggatgatggagaagtatttggcatggcgtcatctgccttgagaaaatctccaatgatgccagaaaacgcagaaaatgaaggagatgccttattacaatttacagcagagttttcttcaagatatggtgattgccatcctgtattttttattggctcattagaagctgcttttcaagaggccttctatgtgaaagcccgagatagaaagcttcttgctatctacctccaccatgatgaaagtgtgttaaccaacgtgttctgctcacaaatgctttgtgctgaatccattgtttcttatctgagtcaaaattttataacctgggcttgggatctgacaaaggactccaacagagcaagatttctcactatgtgcaatagacactttggcagtgttgtggcacaaaccattcggactcaaaaaacggatcagtttccgcttttcctgattattatgggaaagcgatcatctaatgaagtgttgaatgtgatacaagggaacacaacagtagatgagttaatgatgagactcatggctgcaatggagatcttcacagcccaacaacaggaagatataaaggacgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctacttaagatttccca

SEQ ID NO: 308197 - DNA, 2530 bp, Homo sapiens
caggggcggaggcggcggccagggaggaagcggaggaggcggaggcggccgcggcgttcgcccgcccgctcgctcgctcggtttccccgcccccgccgggcttaacgccgctgaaggtatccgggtgcgcgctgtcgcaacctgccctcatcctggcccgcgactgtaagaccggacccacatccagaccaatcttcctgtccgggctgctgcgacgcgggctccgcaggttgcaggcgggcggccggggcgcctgaaggttaccgagtgcatgagcgcctagcgcttcccgcgctgccccgcccgctggcccgccgacccgcccgccggctcgcccgccagcccctcggcgcccggcggcggcggcggcggtggcggcgacggtcgcaggaggtgccgtctgcctcccaggtgcgcgcttcgctcccggagccgcggaactcggcggccgccatggcgtccaacatggaccgggagatgatcctggcggattttcaggcatgtactggcattgaaaacattgacgaagctattacattgcttgaacaaaataattgggacttagtggcagctatcaatggtgtaataccacaggaaaatggcattctacaaagtgaatatggaggtgagaccataccaggacctgcatttaatccagcaagtcatccagcttcagctcctacttcctcttcttcttcagcgtttcgacctgtaatgccatccaggcagattgtagaaaggcaacctcggatgctggacttcagggttgaatacagagacagaaatgttgatgtggtacttgaagacacctgtactgttggagagattaaacagattctagaaaatgaacttcagatacctgtgtccaaaatgctgttaaaaggctggaagacgggagatgtggaagacagtacggtcctaaaatctctacacttgccaaaaaacaacagtctttatgtccttacaccagatttgccaccaccttcatcatctagtcatgctggtgccctgcaggagtcattaaatcaaaacttcatgctgatcatcacccaccgagaagtaaagagaaatgtgtatgaccttacaagtatccccgttcgccaccaattatgggagggctggccaacttctgctacagacgactcaatgtgtcttgctgaatcagggctctcttatccctgccatcgacttacagtgggaagaagatcttcacctgcacagacccgggaacagtcggaagaacaaatcaccgatgttcatatggttagtgatagcgatggagatgactttgaagatgctacagaatttggggtggatgatggagaagtatttggcatggcgtcatctgccttgagaaaatctccaatgatgccagaaaacgcagaaaatgaaggagatgccttattacaatttacagcagagttttcttcaagatatggtgattgccatcctgtattttttattggctcattagaagctgcttttcaagaggccttctatgtgaaagcccgagatagaaagcttcttgctatctacctccaccatgatgaaagtgtgttaaccaacgtgttctgctcacaaatgctttgtgctgaatccattgtttcttatctgagtcaaaattttataacctgggcttgggatctgacaaaggactccaacagagcaagatttctcactatgtgcaatagacactttggcagtgttgtggcacaaaccattcggactcaaaaaacggatcagtttccgcttttcctgattattatgggaaagcgatcatctaatgaagtgttgaatgtgatacaagggaacacaacagtagatgagttaatgatgagactcatggctgcaatggagatcttcacagcccaacaacaggaagatataaaggacgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctacttaagatttccca

SEQ ID NO: 308198 - DNA, 2119 bp, Homo sapiens
  misc_feature (1005)..(1005): n is a, c, g, or t
  misc_feature (1010)..(1011): n is a, c, g, or t
  misc_feature (1017)..(1017): n is a, c, g, or t
  misc_feature (1019)..(1020): n is a, c, g, or t
caggggcggaggcggcggccagggaggaagcggaggaggcggaggcggccgcggcgttcgcccgcccgctcgctcgctcggtttccccgcccccgccgggcttaacgccgctgaaggtatccgggtgcgcgctgtcgcaacctgccctcatcctggcccgcgactgtaagaccggacccacatccagaccaatcttcctgtccgggctgctgcgacgcgggctccgcaggttgcaggcgggcggccggggcgcctgaaggttaccgagtgcatgagcgcctagcgcttcccgcgctgccccgcccgctggcccgccgacccgcccgccggctcgcccgccagcccctcggcgcccggcggcggcggcggcggtggcggcgacggtcgcaggaggtgccgtctgcctcccaggtgcgcgcttcgctcccggagccgcggaactcggcggccgccatggcgtccaacatggaccgggagatgatcctggcggattttcaggcatgtactggcattgaaaacattgacgaagctattacattgcttgaacaaaataattgggacttagtggcagctatcaatggtgtaataccacaggaaaatggcattctacaaagtgaatatggaggtgagaccataccaggacctgcatttaatccagcaagtcatccagcttcagctcctacttcctcttcttcttcagcgtttcgacctgtaatgccatccaggcagattgtagaaaggcaacctcggatgctggacttcagggttgaatacagagacagaaatgttgatgtggtacttgaagacacctgtactgttggagagattaaacagattctagaaaatgaacttcagatacctgtgtccaaaatgctgttaaaaggctggaagacgggagatgtggaagacagtacggtcctaaaatctctacacttgccaaaaaacaacagtctttatgtccttacaccagatttgccaccaccttcatcatctagtcatgctggnctcannttttcntnnagatatggtgattgccatcctgtattttttattggctcattagaagctgcttttcaagaggccttctatgtgaaagcccgagatagaaagcttcttgctatctacctccaccatgatgaaagtgtgttaaccaacgtgttctgctcacaaatgctttgtgctgaatccattgtttcttatctgagtcaaaattttataacctgggcttgggatctgacaaaggactccaacagagcaagatttctcactatgtgcaatagacactttggcagtgttgtggcacaaaccattcggactcaaaaaacggatcagtttccgcttttcctgattattatgggaaagcgatcatctaatgaagtgttgaatgtgatacaagggaacacaacagtagatgagttaatgatgagactcatggctgcaatggagatcttcacagcccaacaacaggaagatataaaggacgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctacttaagatttccca

SEQ ID NO: 308199 - DNA, 2745 bp, Homo sapiens
caggggcggaggcggcggccagggaggaagcggaggaggcggaggcggccgcggcgttcgcccgcccgctcgctcgctcggtttccccgcccccgccgggcttaacgccgctgaaggtatccgggtgcgcgctgtcgcaacctgccctcatcctggcccgcgactgtaagaccggacccacatccagaccaatcttcctgtccgggctgctgcgacgcgggctccgcaggttgcaggcgggcggccggggcgcctgaaggttaccgagtgcatgagcgcctagcgcttcccgcgctgccccgcccgctggcccgccgacccgcccgccggctcgcccgccagcccctcggcgcccggcggcggcggcggcggtggcggcgacggtcgcaggaggtgccgtctgcctcccaggtgcgcgcttcgctcccggagccgcggaactcggcggccgccatggcgtccaacatggaccgggagatgatcctggcggattttcaggcatgtactggcattgaaaacattgacgaagctattacattgcttgaacaaaataattgggacttagtggcagctatcaatggtgtaataccacaggaaaatggcattctacaaagtgaatatggaggtgagaccataccaggacctgcatttaatccagcaagtcatccagcttcagctcctacttcctcttcttcttcagcgtttcgacctgtaatgccatccaggcagattgtagaaaggcaacctcggatgctggacttcagggttgaatacagagacagaaatgttgatgtggtacttgaagacacctgtactgttggagagattaaacagattctagaaaatgaacttcagatacctgtgtccaaaatgctgttaaaaggctggaagacgggagatgtggaagacagtacggtcctaaaatctctacacttgccaaaaaacaacagtctttatgtccttacaccagatttgccaccaccttcatcatctagtcatgctggtgccctgcaggagtcattaaatcaaaacttcatgctgatcatcacccaccgagaagtccagcgggagtacaacctgaacttctcaggaagcagtactattcaagaggtaaagagaaatgtgtatgaccttacaagtatccccgttcgccaccaattatgggagggctggccaacttctgctacagacgactcaatgtgtcttgctgaatcagggctctcttatccctgccatcgacttacagtgggaagaagatcttcacctgcacagacccgggaacagtcggaagaacaaatcaccgatgttcatatggttagtgatagcgatggagatgactttgaagatgctacagaatttggggtggatgatggagaagtatttggcatggcgtcatctgccttgagaaaatctccaatgatgccagaaaacgcagaaaatgaaggagatgccttattacaatttacagcagagttttcttcaagatatggtgattgccatcctgtattttttattggctcattagaagctgcttttcaagaggccttctatgtgaaagcccgagatagaaagcttcttgctatctacctccaccatgatgaaagtgtgttaaccaacgtgttctgctcacaaatgctttgtgctgaatccattgtttcttatctgagtcaaaattttataacctgggcttgggatctgacaaaggactccaacagagcaagatttctcactatgtgcaatagacactttggcagtgttgtggcacaaaccattcggactcaaaaaacggatcagtttccgcttttcctgattattatgggaaagcgatcatctaatgaagtgttgaatgtgatacaagggaacacaacagtagatgagttaatgatgagactcatggctgcaatggagatcttcacagcccaacaacaggaagatataaaggacgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctacttaagatttcccaaaaaaaaaaaaaaacaacaaaaaacaaaaaaacccggggggtttaattgggggggggggaaaaagggcgtaggaaggtgccaggggccaaagcggttccggtgaacccagtcttctggtcacaagggggaaaacggcgggaccccaaaaggggagccgaaaaag

SEQ ID NO: 308200 - DNA, 2643 bp, Homo sapiens
caggggcggaggcggcggccagggaggaagcggaggaggcggaggcggccgcggcgttcgcccgcccgctcgctcgctcggtttccccgcccccgccgggcttaacgccgctgaaggtatccgggtgcgcgctgtcgcaacctgccctcatcctggcccgcgactgtaagaccggacccacatccagaccaatcttcctgtccgggctgctgcgacgcgggctccgcaggttgcaggcgggcggccggggcgcctgaaggttaccgagtgcatgagcgcctagcgcttcccgcgctgccccgcccgctggcccgccgacccgcccgccggctcgcccgccagcccctcggcgcccggcggcggcggcggcggtggcggcgacggtcgcaggaggtgccgtctgcctcccaggtgcgcgcttcgctcccggagccgcggaactcggcggccgccatggcgtccaacatggaccgggagatgatcctggcggattttcaggcatgtactggcattgaaaacattgacgaagctattacattgcttgaacaaaataattgggacttagtggcagctatcaatggtgtaataccacaggaaaatggcattctacaaagtgaatatggaggtgagaccataccaggacctgcatttaatccagcaagtcatccagcttcagctcctacttcctcttcttcttcagcgtttcgacctgtaatgccatccaggcagattgtagaaaggcaacctcggatgctggacttcagggttgaatacagagacagaaatgttgatgtggtacttgaagacacctgtactgttggagagattaaacagattctagaaaatgaacttcagatacctgtgtccaaaatgctgttaaaaggctggaagacgggagatgtggaagacagtacggtcctaaaatctctacacttgccaaaaaacaacagtctttatgtccttacaccagatttgccaccaccttcatcatctagtcatgctggtgccctgcaggagtcattaaatcaaaacttcatgctgatcatcacccaccgagaagtccagcgggagtacaacctgaacttctcaggaagcagtactattcaagaggtaaagagaaatgtgtatgaccttacaagtatccccgttcgccaccaattatgggagggctggccaacttctgctacagacgactcaatgtgtcttgctgaatcagggctctcttatccctgccatcgacttacagtgggaagaagatcttcacctgcacagacccgggaacagtcggaagaacaaatcaccgatgttcatatggttagtgatagcgatggagatgactttgaagatgctacagaatttggggtggatgatggagaagtatttggcatggcgtcatctgccttgagaaaatctccaatgatgccagaaaacgcagaaaatgaaggagatgccttattacaatttacagcagagttttcttcaagatatggtgattgccatcctgtattttttattggctcattagaagctgcttttcaagaggccttctatgtgaaagcccgagatagaaagcttcttgctatctacctccaccatgatgaaagtgtgttaaccaacgtgttctgctcacaaatgctttgtgctgaatccattgtttcttatctgagtcaaaattttataacctgggcttgggatctgacaaaggactccaacagagcaagatttctcactatgtgcaatagacactttggcagtgttgtggcacaaaccattcggactcaaaaaacggatcagtttccgcttttcctgattattatgggaaagcgatcatctaatgaagtgttgaatgtgatacaagggaacacaacagtagatgagttaatgatgagactcatggctgcaatggagatcttcacagcccaacaacaggaagatataaaggacgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctacttaagatttcccacccatccatgagtatatattcccaacccttattacagagaattacaactctgccaccctccc

SEQ ID NO: 308201 - DNA, 2601 bp, Homo sapiens
caggggcggaggcggcggccagggaggaagcggaggaggcggaggcggccgcggcgttcgcccgcccgctcgctcgctcggtttccccgcccccgccgggcttaacgccgctgaaggtatccgggtgcgcgctgtcgcaacctgccctcatcctggcccgcgactgtaagaccggacccacatccagaccaatcttcctgtccgggctgctgcgacgcgggctccgcaggttgcaggcgggcggccggggcgcctgaaggttaccgagtgcatgagcgcctagcgcttcccgcgctgccccgcccgctggcccgccgacccgcccgccggctcgcccgccagcccctcggcgcccggcggcggcggcggcggtggcggcgacggtcgcaggaggtgccgtctgcctcccaggtgcgcgcttcgctcccggagccgcggaactcggcggccgccatggcgtccaacatggaccgggagatgatcctggcggattttcaggcatgtactggcattgaaaacattgacgaagctattacattgcttgaacaaaataattgggacttagtggcagctatcaatggtgtaataccacaggaaaatggcattctacaaagtgaatatggaggtgagaccataccaggacctgcatttaatccagcaagtcatccagcttcagctcctacttcctcttcttcttcagcgtttcgacctgtaatgccatccaggcagattgtagaaaggcaacctcggatgctggacttcagggttgaatacagagacagaaatgttgatgtggtacttgaagacacctgtactgttggagagattaaacagattctagaaaatgaacttcagatacctgtgtccaaaatgctgttaaaaggctggaagacgggagatgtggaagacagtacggtcctaaaatctctacacttgccaaaaaacaacagtctttatgtccttacaccagatttgccaccaccttcatcatctagtcatgctggtgccctgcaggagtcattaaatcaaaacttcatgctgatcatcacccaccgagaagtccagcgggagtacaacctgaacttctcaggaagcagtactattcaagaggtaaagagaaatgtgtatgaccttacaagtatccccgttcgccaccaattatgggagggctggccaacttctgctacagacgactcaatgtgtcttgctgaatcagggctctcttatccctgccatcgacttacagtgggaagaagatcttcacctgcacagacccgggaacagtcggaagaacaaatcaccgatgttcatatggttagtgatagcgatggagatgactttgaagatgctacagaatttggggtggatgatggagaagtatttggcatggcgtcatctgccttgagaaaatctccaatgatgccagaaaacgcagaaaatgaaggagatgccttattacaatttacagcagagttttcttcaagatatggtgattgccatcctgtattttttattggctcattagaagctgcttttcaagaggccttctatgtgaaagcccgagatagaaagcttcttgctatctacctccaccatgatgaaagtgtgttaaccaacgtgttctgctcacaaatgctttgtgctgaatccattgtttcttatctgagtcaaaattttataacctgggcttgggatctgacaaaggactccaacagagcaagatttctcactatgtgcaatagacactttggcagtgttgtggcacaaaccattcggactcaaaaaacggatcagtttccgcttttcctgattattatgggaaagcgatcatctaatgaagtgttgaatgtgatacaagggaacacaacagtagatgagttaatgatgagactcatggctgcaatggagatcttcacagcccaacaacaggaagatataaaggacgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaatttcctcgctttagtgggtatagctacttatgaaaagattaaaaaattggcctggttggcctcat

SEQ ID NO: 308202 - DNA, 2509 bp, Homo sapiens
  misc_feature (2470)..(2471): n is a, c, g, or t
  misc_feature (2498)..(2498): n is a, c, g, or t
caggggcggaggcggcggccagggaggaagcggaggaggcggaggcggccgcggcgttcgcccgcccgctcgctcgctcggtttccccgcccccgccgggcttaacgccgctgaaggtatccgggtgcgcgctgtcgcaacctgccctcatcctggcccgcgactgtaagaccggacccacatccagaccaatcttcctgtccgggctgctgcgacgcgggctccgcaggttgcaggcgggcggccggggcgcctgaaggttaccgagtgcatgagcgcctagcgcttcccgcgctgccccgcccgctggcccgccgacccgcccgccggctcgcccgccagcccctcggcgcccggcggcggcggcggcggtggcggcgacggtcgcaggaggtgccgtctgcctcccaggtgcgcgcttcgctcccggagccgcggaactcggcggccgccatggcgtccaacatggaccgggagatgatcctggcggattttcaggcatgtactggcattgaaaacattgacgaagctattacattgcttgaacaaaataattgggacttagtggcagctatcaatggtgtaataccacaggaaaatggcattctacaaagtgaatatggaggtgagaccataccaggacctgcatttaatccagcaagtcatccagcttcagctcctacttcctcttcttcttcagcgtttcgacctgtaatgccatccaggcagattgtagaaaggcaacctcggatgctggacttcagggttgaatacagagacagaaatgttgatgtggtacttgaagacacctgtactgttggagagattaaacagattctagaaaatgaacttcagatacctgtgtccaaaatgctgttaaaaggctggaagacgggagatgtggaagacagtacggtcctaaaatctctacacttgccaaaaaacaacagtctttatgtccttacaccagatttgccaccaccttcatcatctagtcatgctggtgccctgcaggagtcattaaatcaaaacttcatgctgatcatcacccaccgagaagtccagcgggagtacaacctgaacttctcaggaagcagtactattcaagaggtaaagagaaatgtgtatgaccttacaagtatccccgttcgccaccaattatgggagggctggccaacttctgctacagacgactcaatgtgtcttgctgaatcagggctctcttatccctgccatcgacttacagtgggaagaagatcttcacctgcacagacccgggaacagtcggaagaacaaatcaccgatgttcatatggttagtgatagcgatggagatgactttgaagatgctacagaatttggggtggatgatggagaagtatttggcatggcgtcatctgccttgagaaaatctccaatgatgccagaaaacgcagaaaatgaaggagatgccttattacaatttacagcagagttttcttcaagatatggtgattgccatcctgtattttttattggctcattagaagctgcttttcaagaggccttctatgtgaaagcccgagatagaaagcttcttgctatctacctccaccatgatgaaagtgtgttaaccaacgtgttctgctcacaaatgctttgtgctgaatccattgtttcttatctgagtcaaaattttataacctgggcttgggatctgacaaaggactccaacagagcaagatttctcactatgtgcaatagacactttggcagtgttgtggcacaaaccattcggactcaaaaaacggatcagtttccgcttttcctgattattatgggaaagcgatcatctaatgaagtgttgaatgtgatacaagggaacacaacagtagatgagttaatgatgagactcatggctgcaatggagatcttcacagcccaacaacaggaagatataaaggacgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgtaactcaactggacccaaataaatcattattggaggtaaagttgttccctcaagaaacccttttccttgaagcaaaagagtaaacacggcccagcggtggaaccagccattcccaaggcaaacgaacgacagcgaagacagacaagnnaagaggcgagaggaccaagcgcagcanacgaatggcta

SEQ ID NO: 308203 - DNA, 1654 bp, Homo sapiens
  misc_feature (11)..(11): n is a, c, g, or t
  misc_feature (18)..(19): n is a, c, g, or t
  misc_feature (22)..(22): n is a, c, g, or t
  misc_feature (32)..(32): n is a, c, g, or t
ttttttggccntaaaaannccnccggaagggntccaacagagcaagatttctcactatgtgcaatagacactttggcagtgttgtggcacaaaccattcggactcaaaaaacggatcagtttccgcttttcctgattattatgggaaagcgatcatctaatgaagtgttgaatgtgatacaagggaacacaacagtagatgagttaatgatgagactcatggctgcaatggagatcttcacagcccaacaacaggaagatataaaggacgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgagccatccggctgtccttagagcaagccctgcctcctgagccaaaggaagaaaatctccaatgatgccagaaaacgcagaaaatgaaggagatgccttattacaatttacagcagagttttcttcaagatatggtgattgccatcctgtattttttattggctcattagaagctgcttttcaagaggccttctatgtgaaagcccgagatagaaagcttcttgctatctacctccaccatgatgaaagtgtgttaaccaacgtgttctgctcacaaatgctttgtgctgaatccattgtttcttatctgagtcaaaattttataacctgggcttgggatctgacaaaggactccaacagagcaagatttctcactatgtgcaatagacactttggcagtgttgtggcacaaaccattcggactcaaaaaacggatcagtttccgcttttcctgattattatgggaaagcgatcatctaatgaagtgttgaatgtgatacaagggaacacaacagtagatgagttaatgatgagactcatggctgcaatggagatcttcacagcccaacaacaggaagatataaaggacgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctacttaagatttccca

SEQ ID NO: 308204 - DNA, 1739 bp, Homo sapiens
ttctatatagtgctaaaagtccttctcattaagaaactgctccctcaaatataacttccgaaatttcaactgccagtatactactatttcttattgaacatatgaaacatttcaataaaaccacaaaagtattttaactgtaatttttttagactgattattcctttctggttaattctagaatgactttccagtttctaatactttaataatttgaagttatatataaaatgattataaaagtttggcaatctctatatgtttttagggaacacaacagtagatgagttaatgatgagactcatggctgcaatggagatcttcacagcccaacaacaggaagatataaaggacgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgagccatccggctgtccttagagcaagccctgcctcctgagccaaaggaagaaaatctccaatgatgccagaaaacgcagaaaatgaaggagatgccttattacaatttacagcagagttttcttcaagatatggtgattgccatcctgtattttttattggctcattagaagctgcttttcaagaggccttctatgtgaaagcccgagatagaaagcttcttgctatctacctccaccatgatgaaagtgtgttaaccaacgtgttctgctcacaaatgctttgtgctgaatccattgtttcttatctgagtcaaaattttataacctgggcttgggatctgacaaaggactccaacagagcaagatttctcactatgtgcaatagacactttggcagtgttgtggcacaaaccattcggactcaaaaaacggatcagtttccgcttttcctgattattatgggaaagcgatcatctaatgaagtgttgaatgtgatacaagggaacacaacagtagatgagttaatgatgagactcatggctgcaatggagatcttcacagcccaacaacaggaagatataaaggacgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctacttaagatttccca

SEQ ID NO: 308205 - DNA, 2376 bp, Homo sapiens
caggggcggaggcggcggccagggaggaagcggaggaggcggaggcggccgcggcgttcgcccgcccgctcgctcgctcggtttccccgcccccgccgggcttaacgccgctgaaggtatccgggtgcgcgctgtcgcaacctgccctcatcctggcccgcgactgtaagaccggacccacatccagaccaatcttcctgtccgggctgctgcgacgcgggctccgcaggttgcaggcgggcggccggggcgcctgaaggttaccgagtgcatgagcgcctagcgcttcccgcgctgccccgcccgctggcccgccgacccgcccgccggctcgcccgccagcccctcggcgcccggcggcggcggcggcggtggcggcgacggtcgcaggaggtgccgtctgcctcccaggtgcgcgcttcgctcccggagccgcggaactcggcggccgccatggcgtccaacatggaccgggagatgatcctggcggattttcaggcatgtactggcattgaaaacattgacgaagctattacattgcttgaacaaaataattgggacttagtggcagctatcaatggtgtaataccacaggaaaatggcattctacaaagtgaatatggaggtgagaccataccaggacctgcatttaatccagcaagtcatccagcttcagctcctacttcctcttcttcttcagcgtttcgacctgtaatgccatccaggcagattgtagaaaggcaacctcggatgctggacttcagggttgaatacagagacagaaatgttgatgtggtacttgaagacacctgtactgttggagagattaaacagattctagaaaatgaacttcagatacctgtgtccaaaatgctgttaaaaggctggaagacgggagatgtggaagacagtacggtcctaaaatctctacacttgccaaaaaacaacagtctttatgtccttacaccagatttgccaccaccttcatcatctagtcatgctggtgccctgcaggagtcattaaatcaaaacttcatgctgatcatcacccaccgagaagtccagcgggagtacaacctgaacttctcaggaagcagtactattcaagaggtaaagagaaatgtgtatgaccttacaagtatccccgttcgccaccaattatgggagggctggccaacttctgctacagacgactcaatgtgtcttgctgaatcagggctctcttatccctgccatcgacttacagtgggaagaagatcttcacctgcacagacccgggaacagtcggaagaacaaatcaccgatgttcatatggttagtgatagcgatggagatgactttgaagatgctacagaatttggggtggatgatggagaagtatttggcatggcgtcatctgccttgagaaaatctccaatgatgccagaaaacgcagaaaatgaaggagatgccttattacaatttacagcagagttttcttcaagatatggtgattgccatcctgtattttttattggctcattagaagctgcttttcaagaggccttctatgtgaaagcccgagatagaaagcttcttgctatctacctccaccatgatgaaagtgtgttaaccaacgtgttctgctcacaaatgctttgtgctgaatccattgtttcttatctgagtcaaaattttataacctgggcttgggatctgacaaaggactccaacagagcaagatttctcactatgtgcaatagacactttggcagtgttgtggcacaaaccattcggactcaaaaaacggatcagtttccgcttttcctgattattatgggaaagcgatcatctaatgaagtgttgaatgtgatacaagggaacacaacagtagatgagttaatgatgagactcatggctgcaatggagatcttcacagcccaacaacaggaagatataaaggacgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgagacaatccggatgtacttaagagctcagccatgaactacctgcaaccacaggaaagaacaatgctgaagcctagagaagacaaaacgatgcgggagtccgagaaccaccaagaggacgaagtccatagaaagcagggcgttatccatgggaccaagaacgaacctcccagaaatggacataagaacaatcgaaacacacatcgccaaacaggaaacaccactgagaatgaagaccaagacaactggagcaacatatcctaaggaagaaaag

SEQ ID NO: 308206 - DNA, 2739 bp, Homo sapiens
caggggcggaggcggcggccagggaggaagcggaggaggcggaggcggccgcggcgttcgcccgcccgctcgctcgctcggtttccccgcccccgccgggcttaacgccgctgaaggtatccgggtgcgcgctgtcgcaacctgccctcatcctggcccgcgactgtaagaccggacccacatccagaccaatcttcctgtccgggctgctgcgacgcgggctccgcaggttgcaggcgggcggccggggcgcctgaaggttaccgagtgcatgagcgcctagcgcttcccgcgctgccccgcccgctggcccgccgacccgcccgccggctcgcccgccagcccctcggcgcccggcggcggcggcggcggtggcggcgacggtcgcaggaggtgccgtctgcctcccaggtgcgcgcttcgctcccggagccgcggaactcggcggccgccatggcgtccaacatggaccgggagatgatcctggcggattttcaggcatgtactggcattgaaaacattgacgaagctattacattgcttgaacaaaataattgggacttagtggcagctatcaatggtgtaataccacaggaaaatggcattctacaaagtgaatatggaggtgagaccataccaggacctgcatttaatccagcaagtcatccagcttcagctcctacttcctcttcttcttcagcgtttcgacctgtaatgccatccaggcagattgtagaaaggcaacctcggatgctggacttcagggttgaatacagagacagaaatgttgatgtggtacttgaagacacctgtactgttggagagattaaacagattctagaaaatgaacttcagatacctgtgtccaaaatgctgttaaaaggctggaagacgggagatgtggaagacagtacggtcctaaaatctctacacttgccaaaaaacaacagtctttatgtccttacaccagatttgccaccaccttcatcatctagtcatgctggtgccctgcaggagtcattaaatcaaaacttcatgctgatcatcacccaccgagaagtccagcgggagtacaacctgaacttctcaggaagcagtactattcaagaggtaaagagaaatgtgtatgaccttacaagtatccccgttcgccaccaattatgggagggctggccaacttctgctacagacgactcaatgtgtcttgctgaatcagggctctcttatccctgccatcgacttacagtgggaagaagatcttcacctgcacagacccgggaacagtcggaagaacaaatcaccgatgttcatatggttagtgatagcgatggagatgactttgaagatgctacagaatttggggtggatgatggagaagtatttggcatggcgtcatctgccttgagaaaatctccaatgatgccagaaaacgcagaaaatgaaggagatgccttattacaatttacagcagagttttcttcaagatatggtgattgccatcctgtattttttattggctcattagaagctgcttttcaagaggccttctatgtgaaagcccgagatagaaagcttcttgctatctacctccaccatgatgaaagtgtgttaaccaacgtgttctgctcacaaatgctttgtgctgaatccattgtttcttatctgagtcaaaattttataacctgggcttgggatctgacaaaggactccaacagagcaagatttctcactatgtgcaatagacactttggcagtgttgtggcacaaaccattcggactcaaaaaacggatcagtttccgcttttcctgattattatgggaaagcgatcatctaatgaagtgttgaatgtgatacaaggaacgggatagcgacgagacgacgctagcatgagctttacactgagtgatcactcgagtggtctgcgataatgggcccgtatctctcgaccaggcccaggcgacagcccgcgaaagaattactagagaggggacgcacagagttcaactgtgtatagcctaacagcaaaatgtcgaatgaagaagacgcaacgcatggaaggcacgtgatcggcgctcttcaacttggagggcatgacgaggaggcagggagagggcgcatgctctactgaggacgatgagattggcgagagactatgtttcgttttcgtgatccccgtagttccgccaaaggagaccacagaccgatggaagggtgacggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaatttgtggaaagtatataatttgttcttaaaaaaaaaaaccggggctctttcggggggaagggtggtggctggcaggtctgcccttttcaag

SEQ ID NO: 308207 - DNA, 526 bp, Homo sapiens
tggtgtctctacttgttacgtgatatattttgtattgtattgtgattttcggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctacttaagatttccca

SEQ ID NO: 308208 - DNA, 1070 bp, Homo sapiens
  misc_feature (11)..(11): n is a, c, g, or t
  misc_feature (18)..(19): n is a, c, g, or t
  misc_feature (22)..(22): n is a, c, g, or t
  misc_feature (32)..(32): n is a, c, g, or t
ttttttggccntaaaaannccnccggaagggntccaacagagcaagatttctcactatgtgcaatagacactttggcagtgttgtggcacaaaccattcggactcaaaaaacggatcagtttccgcttttcctgattattatgggaaagcgatcatctaatgaagtgttgaatgtgatacaagggaacacaacagtagatgagttaatgatgagactcatggctgcaatggagatcttcacagcccaacaacaggaagatataaaggacgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctacttaagatttcccaaaaaaaaaaaaaaacaacaaaaaacaaaaaaacccggggggtttaattgggggggggggaaaaagggcgtaggaaggtgccaggggccaaagcggttccggtgaacccagtcttctggtcacaagggggaaaacggcgggaccccaaaaggggagccgaaaaag

SEQ ID NO: 308209 - DNA, 877 bp, Homo sapiens
caggggcggaggcggcggccagggaggaagcggaggaggcggaggcggccgcggcgttcgcccgcccgctcgctcgctcggtttccccgcccccgccgggcttaacgccgctgaaggtatccgggtgcgcgctgtcgcaacctgccctcatcctggcccgcgactgtaagaccggacccacatccagaccaatcttcctgtccgggctgctgcgacgcgggctccgcaggttgcaggcgggcggccggggcgcctgaaggttaccgagtgcatgagcgcctagcgcttcccgcgctgccccgcccgctggcccgccgacccgcccgccggctcgcccgccagcccctcggcgcccggcggcggcggcggcggtggcggcgacggtcgcaggaggtgccgtctgcctcccaggtgcgcgcttcgctcccggagccgcggaactcggcggccgccatggcgtccaacatggaccgggagatgatcctggcggattttcaggcatgtactggcattgaaaacattgacgaagctattacattgcttgaacaaaataattgggacttagtggcagctatcaatggtgtaataccacaggaaaatggcattctacaaagtgaatatggaggtgagaccataccaggacctgcatttaatccagcaagtcatccagcttcagctcctacttcctcttcttcttcagcgtttcgacctgtaatgccatccaggcagattgtagaaaggcaacctcggatgctggacttcagggttgaatacagagacagaaatgttgatgtggtacttgaagacacctgtactgttggtaaggtttttcctgccataaagccttcacaaataaataattaggtaaacattcagg

SEQ ID NO: 308210 - DNA, 1566 bp, Homo sapiens
agagatccacccctccccatccccatcacaaggaaggtaggcattagtttgcaagagttcaagcccttagatctgcttttgaaggagaagaggctatttgtaagaaagctggtaagtttctattccaaggttcatgatctaataggaagactgcaggtgtggccgtcaggcccaagtcctaggtgagaatgcaggtctgcgagcccctaggaccggaccataacgaccttaacagccctaacggccgtaactgccataacggccggctgcgcgaggcccttccagcatttccactttcgtcaggtactggagagggctgccggccggatgccaggcagaggggcagggcggacggctaggagttcaagaaacatcctggtctgagggaaaggctgcagcctgcaccgccatgaataagcttttcagcttctggaagaggaagaatgagacccgcagccagggctacaaccttcgagaaaaggatttaaagaaacttcacagagctgcttcagtcggggatttgaagaagctgaaggaataccttcagatcaagaaatatgatgtaaatatgcaggacaaaaaatacagaacacctttgcacctagcctgtgctaatggacatacagatgttgtacttttcctaattgagcaacaatgcaaaataaatgtccgggatagtgaaaacaaatccccattgattaaggcagtacagtgtcaaaatgaggattgtgctactattcttctaaactttggtgcagacccagatctgagggatattcgttataatactgttcttcactatgctgtttgtggtcaaagtttgtcattagttgaaaaactgcttgaatacgaagctgatcttgaagcgaaaaataaggatgggtatactccactattagttgccgttattaacaataatccaaaaatggtaaaatttcttctggagaaaggggctgatgtgaatgcttcagataattatcaaagaacagcccttattcttgctgtcagtggtgaaccaccatgtttagtaaagcttcttcttcagcaaggtgtggaattatgttacgaaggtattgtggattcacagctgaggaatatgtttatttccatggttttactgcatagatacccacaattcactgcgagccatggaaagaagaaacatgctaaatagacaccttattcttggcactacatgtgactaaaggaagatatggaacccatttctacaatttctttgccgcttccttgaattggaaaaatgtactttgaaagaaccgttaagtgaactattataatatttttgctgactacccagttgaagaaaagtttgttaattggatgggattttttttttttcacgttagaagacatgaagaaattttaaaagataaacatctatattgtgaaccatcagctgaaaagataaatttgtgttcaatatataggcagaaaaaaatttgtgtcaaaatgttgaatggaataataatgaggaaactgtgttaggcatgtattaaaacatttaaataaaataaaaatacatttcagctacaaagtgaaggaaaa

SEQ ID NO: 308211 - DNA, 526 bp, Homo sapiens
cctaaggttttgatttgatacttatatgttaggaattaaatttctatgcatgctggcattcacacgtaatttcctttatagatagatacccacaattcactgcgagccatggaaagaagaaacatgctaaatagacaccttattcttggcactacatgtgactaaaggaagatatggaacccatttctacaatttctttgccgcttccttgaattggaaaaatgtactttgaaagaaccgttaagtgaactattataatatttttgctgactacccagttgaagaaaagtttgttaattggatgggattttttttttttcacgttagaagacatgaagaaattttaaaagataaacatctatattgtgaaccatcagctgaaaagataaatttgtgttcaatatataggcagaaaaaaatttgtgtcaaaatgttgaatggaataataatgaggaaactgtgttaggcatgtattaaaacatttaaataaaataaaaatacatttcagctacaaagtgaaggaaaa

SEQ ID NO: 308212 - DNA, 1594 bp, Homo sapiens
agagatccacccctccccatccccatcacaaggaaggtaggcattagtttgcaagagttcaagcccttagatctgcttttgaaggagaagaggctatttgtaagaaagctggtaagtttctattccaaggttcatgatctaataggaagactgcaggtgtggccgtcaggcccaagtcctaggtgagaatgcaggtctgcgagcccctaggaccggaccataacgaccttaacagccctaacggccgtaactgccataacggccggctgcgcgaggcccttccagcatttccactttcgtcaggtactggagagggctgccggccggatgccaggcagaggggcagggcggacggctaggagttcaagaaacatcctggtctgagggaaaggctgcagcctgcaccgccatgaataagcttttcagcttctggaagaggaagaatgagacccgcagccagggctacaaccttcgagaaaaggatttaaagaaacttcacagagctgcttcagtcggggatttgaagaagctgaaggaataccttcagatcaagaaatatgatgtaaatatgcaggacaaaaaatacagaacacctttgcacctagcctgtgctaatggacatacagatgttgtacttttcctaattgagcaacaatgcaaaataaatgtccgggatagtgaaaacaaatccccattgattaaggcagtacagtgtcaaaatgaggattgtgctactattcttctaaactttggtgcagacccagatctgagggatattcgttataatactgttcttcactatgctgtttgtggtcaaagtttgtcattagttgaaaaactgcttgaatacgaagctgatcttgaagcgaaaaataaggatgggtatactccactattagttgccgttattaacaataatccaaaaatggtaaaatttcttctggagaaaggggctgatgtgaatgcttcagataattatcaaagaacagcccttattcttgctgtcagtggtgaaccaccatgtttagtaaagcttcttcttcagcaaggtgtggaattatgttacgaaggtattgtggattcacagctgaggaatatgtttatttccatggttttactgcatagatacccacaattcactgcgagccatggaaagaagaaacatgctaaatagacaccttattcttggcactacatgtgactaaaggaagatatggaacccatttctacaatttctttgccgcttccttgaattggaaaaatgtactttgaaagaaccgttaagtgaactattataatatttttgctgactacccagttgaagaaaagtttgttaattggatgggattttttttttttcacgttagaagacatgaagaaattttaaaagataaacatctatattgtgaaccatcagctgaaaagataaatttgtgttcaatatataggcagaaaaaaatttgtgtcaaaatgttgaatggaataataatgaggaaactgtgttaggcatgtattaaaacatttaaataaaataaaaatacatttcagctacaaagtgaaggaaaacattataaataatcctgtataaatcaaa

SEQ ID NO: 308213 - DNA, 1769 bp, Homo sapiens
agagatccacccctccccatccccatcacaaggaaggtaggcattagtttgcaagagttcaagcccttagatctgcttttgaaggagaagaggctatttgtaagaaagctggtaagtttctattccaaggttcatgatctaataggaagactgcaggtgtggccgtcaggcccaagtcctaggtgagaatgcaggtctgcgagcccctaggaccggaccataacgaccttaacagccctaacggccgtaactgccataacggccggctgcgcgaggcccttccagcatttccactttcgtcaggtactggagagggctgccggccggatgccaggcagaggggcagggcggacggctaggagttcaagaaacatcctggtctgagggaaaggctgcagcctgcaccgccatgaataagcttttcagcttctggaagaggaagaatgagacccgcagccagggctacaaccttcgagaaaaggatttaaagaaacttcacagagctgcttcagtcggggatttgaagaagctgaaggaataccttcagatcaagaaatatgatgtaaatatgcaggacaaaaaatacagaacacctttgcacctagcctgtgctaatggacatacagatgttgtacttttcctaattgagcaacaatgcaaaataaatgtccgggatagtgaaaacaaatccccattgattaaggcagtacagtgtcaaaatgaggattgtgctactattcttctaaactttggtgcagacccagatctgagggatattcgttataatactgttcttcactatgctgtttgtggtcaaagtttgtcattagttgaaaaactgcttgaatacgaagctgatcttgaagcgaaaaataaggatgggtatactccactattagttgccgttattaacaataatccaaaaatggtaaaatttcttctggagaaaggggctgatgtgaatgcttcagataattatcaaagaacagcccttattcttgctgtcagtggtgaaccaccatgtttagtaaagcttcttcttcagcaaggtgtggaattatgttacgaaggtattgtggattcacagctgaggaatatgtttatttccatggttttactgcatagatacccacaattcactgcgagccatggaaagaagaaacatgctaaatagacaccttattcttggcactacatgtgactaaaggaagatatggaacccatttctacaatttctttgccgcttccttgaattggaaaaatgtactttgaaagaaccgttaagtgaactattataatatttttgctgactacccagttgaagaaaagtttgttaattggatgggattttttttttttcacgttagaagacatgaagaaattttaaaagataaacatctatattgtgaaccatcagctgaaaagataaatttgtgttcaatatataggcagaaaaaaatttgtgtcaaaatgttgaatggaataataatgaggaaactgtgttaggcatgtattaaaacatttaaataaaataaaaatacatttcagctacaaagtgaaggaaaaaaaaaaaaaaaaaaaaaaaaaaaaaaaaaaaaacaaaaaaaaaaaaaaaaaaaacaaaaaaaaacaaacaaaaaaaacaacccccgccgcccgcgcgcacgccaccagaaaggggcggcgcaccctcccgcgggagggggcggcccccacgccctcgtgcgccccccacagtgaggggggcattacagcgccgcggcgaacgt

SEQ ID NO: 308214 - DNA, 1540 bp, Homo sapiens
agagatccacccctccccatccccatcacaaggaaggtaggcattagtttgcaagagttcaagcccttagatctgcttttgaaggagaagaggctatttgtaagaaagctggtaagtttctattccaaggttcatgatctaataggaagactgcaggtgtggccgtcaggcccaagtcctaggtgagaatgcaggtctgcgagcccctaggaccggaccataacgaccttaacagccctaacggccgtaactgccataacggccggctgcgcgaggcccttccagcatttccactttcgtcaggtactggagagggctgccggccggatgccaggcagaggggcagggcggacggctaggagttcaagaaacatcctggtctgagggaaaggctgcagcctgcaccgccatgaataagcttttcagcttctggaagaggaagaatgagacccgcagccagggctacaaccttcgagaaaaggatttaaagaaacttcacagagctgcttcagtcggggatttgaagaagctgaaggaataccttcagatcaagaaatatgataacacctttgcacctagcctgtgctaatggacatacagatgttgtacttttcctaattgagcaacaatgcaaaataaatgtccgggatagtgaaaacaaatccccattgattaaggcagtacagtgtcaaaatgaggattgtgctactattcttctaaactttggtgcagacccagatctgagggatattcgttataatactgttcttcactatgctgtttgtggtcaaagtttgtcattagttgaaaaactgcttgaatacgaagctgatcttgaagcgaaaaataaggatgggtatactccactattagttgccgttattaacaataatccaaaaatggtaaaatttcttctggagaaaggggctgatgtgaatgcttcagataattatcaaagaacagcccttattcttgctgtcagtggtgaaccaccatgtttagtaaagcttcttcttcagcaaggtgtggaattatgttacgaaggtattgtggattcacagctgaggaatatgtttatttccatggttttactgcatagatacccacaattcactgcgagccatggaaagaagaaacatgctaaatagacaccttattcttggcactacatgtgactaaaggaagatatggaacccatttctacaatttctttgccgcttccttgaattggaaaaatgtactttgaaagaaccgttaagtgaactattataatatttttgctgactacccagttgaagaaaagtttgttaattggatgggattttttttttttcacgttagaagacatgaagaaattttaaaagataaacatctatattgtgaaccatcagctgaaaagataaatttgtgttcaatatataggcagaaaaaaatttgtgtcaaaatgttgaatggaataataatgaggaaactgtgttaggcatgtattaaaacatttaaataaaataaaaatacatttcagctacaaagtgaaggaaaa

SEQ ID NO: 308215 - DNA, 1626 bp, Homo sapiens
agagatccacccctccccatccccatcacaaggaaggtaggcattagtttgcaagagttcaagcccttagatctgcttttgaaggagaagaggctatttgtaagaaagctggtaagtttctattccaaggttcatgatctaataggaagactgcaggtgtggccgtcaggcccaagtcctaggtgagaatgcaggtctgcgagcccctaggaccggaccataacgaccttaacagccctaacggccgtaactgccataacggccggctgcgcgaggcccttccagcatttccactttcgtcaggtactggagagggctgccggccggatgccaggcagaggggcagggcggacggctaggagttcaagaaacatcctggtctgagggaaaggctgcagcctgcaccgccatgaataagcttttcagcttctggaagaggaagaatgagacccgcagccagggctacaaccttcgagaaaaggatttaaagaaacttcacagagctgcttcagtcggggatttgaagaagctgaaggaataccttcagatcaagaaatatgatgtaaatatgcaggacaaaaaatacagtgttgtccaatcttctagatggcttttatcctacaccactccgctgaatgactttataagaacacctttgcacctagcctgtgctaatggacatacagatgttgtacttttcctaattgagcaacaatgcaaaataaatgtccgggatagtgaaaacaaatccccattgattaaggcagtacagtgtcaaaatgaggattgtgctactattcttctaaactttggtgcagacccagatctgagggatattcgttataatactgttcttcactatgctgtttgtggtcaaagtttgtcattagttgaaaaactgcttgaatacgaagctgatcttgaagcgaaaaataaggatgggtatactccactattagttgccgttattaacaataatccaaaaatggtaaaatttcttctggagaaaggggctgatgtgaatgcttcagataattatcaaagaacagcccttattcttgctgtcagtggtgaaccaccatgtttagtaaagcttcttcttcagcaaggtgtggaattatgttacgaaggtattgtggattcacagctgaggaatatgtttatttccatggttttactgcatagatacccacaattcactgcgagccatggaaagaagaaacatgctaaatagacaccttattcttggcactacatgtgactaaaggaagatatggaacccatttctacaatttctttgccgcttccttgaattggaaaaatgtactttgaaagaaccgttaagtgaactattataatatttttgctgactacccagttgaagaaaagtttgttaattggatgggattttttttttttcacgttagaagacatgaagaaattttaaaagataaacatctatattgtgaaccatcagctgaaaagataaatttgtgttcaatatataggcagaaaaaaatttgtgtcaaaatgttgaatggaataataatgaggaaactgtgttaggcatgtattaaaacatttaaataaaataaaaatacatttcagctacaaagtgaaggaaaa

SEQ ID NO: 308216 - DNA, 1600 bp, Homo sapiens
agagatccacccctccccatccccatcacaaggaaggtaggcattagtttgcaagagttcaagcccttagatctgcttttgaaggagaagaggctatttgtaagaaagctggtaagtttctattccaaggttcatgatctaataggaagactgcaggtgtggccgtcaggcccaagtcctaggtgagaatgcaggtctgcgagcccctaggaccggaccataacgaccttaacagccctaacggccgtaactgccataacggccggctgcgcgaggcccttccagcatttccactttcgtcaggtactggagagggctgccggccggatgccaggcagaggggcagggcggacggctaggagttcaagaaacatcctggtctgagggaaaggctgcagcctgcaccgccatgaataagcttttcagcttctggaagaggaagaatgagacccgcagccagggctacaaccttcgagaaaaggatttaaagaaacttcacagagctgcttcagtcggggatttgaagaagctgaaggaataccttcagatcaagaaatatgattgttgtccaatcttctagatggcttttatcctacaccactccgctgaatgactttataagaacacctttgcacctagcctgtgctaatggacatacagatgttgtacttttcctaattgagcaacaatgcaaaataaatgtccgggatagtgaaaacaaatccccattgattaaggcagtacagtgtcaaaatgaggattgtgctactattcttctaaactttggtgcagacccagatctgagggatattcgttataatactgttcttcactatgctgtttgtggtcaaagtttgtcattagttgaaaaactgcttgaatacgaagctgatcttgaagcgaaaaataaggatgggtatactccactattagttgccgttattaacaataatccaaaaatggtaaaatttcttctggagaaaggggctgatgtgaatgcttcagataattatcaaagaacagcccttattcttgctgtcagtggtgaaccaccatgtttagtaaagcttcttcttcagcaaggtgtggaattatgttacgaaggtattgtggattcacagctgaggaatatgtttatttccatggttttactgcatagatacccacaattcactgcgagccatggaaagaagaaacatgctaaatagacaccttattcttggcactacatgtgactaaaggaagatatggaacccatttctacaatttctttgccgcttccttgaattggaaaaatgtactttgaaagaaccgttaagtgaactattataatatttttgctgactacccagttgaagaaaagtttgttaattggatgggattttttttttttcacgttagaagacatgaagaaattttaaaagataaacatctatattgtgaaccatcagctgaaaagataaatttgtgttcaatatataggcagaaaaaaatttgtgtcaaaatgttgaatggaataataatgaggaaactgtgttaggcatgtattaaaacatttaaataaaataaaaatacatttcagctacaaagtgaaggaaaa

SEQ ID NO: 308217 - DNA, 1121 bp, Homo sapiens
ctagcggtggtggtctttgctaggtctggaggtagagcagatgctgaggcgttcaaaggaaggcggtgcctgtggacaagcaggcttgcacaggatctggcccgtgccgaccagggcgccaggaccctgaaagtctcgtcccaaacacctttgcacctagcctgtgctaatggacatacagatgttgtacttttcctaattgagcaacaatgcaaaataaatgtccgggatagtgaaaacaaatccccattgattaaggcagtacagtgtcaaaatgaggattgtgctactattcttctaaactttggtgcagacccagatctgagggatattcgttataatactgttcttcactatgctgtttgtggtcaaagtttgtcattagttgaaaaactgcttgaatacgaagctgatcttgaagcgaaaaataaggatgggtatactccactattagttgccgttattaacaataatccaaaaatggtaaaatttcttctggagaaaggggctgatgtgaatgcttcagataattatcaaagaacagcccttattcttgctgtcagtggtgaaccaccatgtttagtaaagcttcttcttcagcaaggtgtggaattatgttacgaaggtattgtggattcacagctgaggaatatgtttatttccatggttttactgcatagatacccacaattcactgcgagccatggaaagaagaaacatgctaaatagacaccttattcttggcactacatgtgactaaaggaagatatggaacccatttctacaatttctttgccgcttccttgaattggaaaaatgtactttgaaagaaccgttaagtgaactattataatatttttgctgactacccagttgaagaaaagtttgttaattggatgggattttttttttttcacgttagaagacatgaagaaattttaaaagataaacatctatattgtgaaccatcagctgaaaagataaatttgtgttcaatatataggcagaaaaaaatttgtgtcaaaatgttgaatggaataataatgaggaaactgtgttaggcatgtattaaaacatttaaataaaataaaaatacatttcagctacaaagtgaaggaaaa

SEQ ID NO: 308218 - DNA, 1515 bp, Homo sapiens
agagatccacccctccccatccccatcacaaggaaggtaggcattagtttgcaagagttcaagcccttagatctgcttttgaaggagaagaggctatttgtaagaaagctggtaagtttctattccaaggttcatgatctaataggaagactgcaggtgtggccgtcaggcccaagtcctaggtgagaatgcaggtctgcgagcccctaggaccggaccataacgaccttaacagccctaacggccgtaactgccataacggccggctgcgcgaggcccttccagcatttccactttcgtcaggtactggagagggctgccggccggatgccaggcagaggggcagggcggacggctaggagttcaagaaacatcctggtctgagggaaaggctgcagcctgcaccgccatgaataagcttttcagcttctggaagaggaagaatgagacccgcagccagggctacaaccttcgagaaaaggatttaaagaaacttcacagagctgcttcagtcggggatttgaagaagctgaaggaataccttcagatcaagaaatatgatgtaaatatgcaggacaaaaaatacagaacacctttgcacctagcctgtgctaatggacatacagatgttgtacttttcctaattgagcaacaatgcaaaataaatgtccgggatagtgaaaacaaatccccattgattaaggcagtacagtgtcaaaatgaggattgtgctactattcttctaaactttggtgcagacccagatctgagggatattcgttataatactgttcttcactatgctgtttgtggtcaaagtttgtcattagttgaaaaactgcttgaatacgaagctgatcttgaagcgaaaaataaggatgggtatactccactattagttgccgttattaacaataatccaaaaatggtaaaatttcttctggagaaaggggctgatgtgaatgcttcagataattatcaaagaacagcccttattcttgctgtcagtggtgaaccaccatgtttagtaaagcttcttcttcagcaaggtgtggaattatgttacgaagatagatacccacaattcactgcgagccatggaaagaagaaacatgctaaatagacaccttattcttggcactacatgtgactaaaggaagatatggaacccatttctacaatttctttgccgcttccttgaattggaaaaatgtactttgaaagaaccgttaagtgaactattataatatttttgctgactacccagttgaagaaaagtttgttaattggatgggattttttttttttcacgttagaagacatgaagaaattttaaaagataaacatctatattgtgaaccatcagctgaaaagataaatttgtgttcaatatataggcagaaaaaaatttgtgtcaaaatgttgaatggaataataatgaggaaactgtgttaggcatgtattaaaacatttaaataaaataaaaatacatttcagctacaaagtgaaggaaaa

SEQ ID NO: 308219 - DNA, 779 bp, Homo sapiens
cggggggggggggggggcggggcgaagccgaggaagagcgttttggggacgggggctggtgaggctcacgttggagggcttcgcgtctgcttcggagaccgtaaggatattgatgaccatgagatccctgctcagaacccccttcctgtgtggcctgctctgggccttttgtgccccaggcgccagggctgaggagcctgcagccagcttctcccaacccggcagcatgggcctggataagaacacagtgcacgaccaagagcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaatgcaaaataactcatttccaactactgctgcagcattttggtaaaaacctgtagcgattcgttacactggggtgagaagagataagagaaatgaaagagaagagaaatgggacatctaatagtccctaagtgctattaaataccttattggacaagg

SEQ ID NO: 308220 - DNA, 1056 bp, Homo sapiens
cggggggggggggggggcggggcgaagccgaggaagagcgttttggggacgggggctggtgaggctcacgttggagggcttcgcgtctgcttcggagaccgtaagggcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaatgcaaaataactcatttccaactactgctgcagcattttggtaaaaacctgtagcgattcgttacactggggtgagaagagataagagaaatgaaagagaagagaaatgggacatctaatagtccctaagtgctattaaataccttattggacaagggcttgcttcaagcatctgtattagtctgtattaatgctgctgataaagacgtacccgagactgggaagaaaaagaggtttacttggacttacagttccacatggctggggaggcctcagaatcatggcgggaggtgaaaggcacttcttacatggcagcaagagaaaatgaggaagaagcaaaagtggaaacccctgataagccatcagatcttgtgaaacttattcactatcacaagaatagcatgggaaagactggcccccatgattcaattacctccccttgggtctctcccacaacacgtgggaattctggtagatacaatttcaagttgagatttgggtggggacatagccaaaccatatcattctacccctggcccctccaaatctcatgtcctcactattcaaaaccaatcatgccttcctaaca

SEQ ID NO: 308221 - DNA, 624 bp, Homo sapiens
cggggggggggggggggcggggcgaagccgaggaagagcgttttggggacgggggctggtgaggctcacgttggagggcttcgcgtctgcttcggagaccgtaagggcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaatgcaaaataactcatttccaactactgctgcagcattttggtaaaaacctgtagcgattcgttacactggggtgagaagagataagagaaatgaaagagaagagaaatgggacatctaatagtccctaagtgctattaaataccttattggacaagg

SEQ ID NO: 308222 - DNA, 896 bp, Homo sapiens
cggggggggggggggggcggggcgaagccgaggaagagcgttttggggacgggggctggtgaggctcacgttggagggcttcgcgtctgcttcggagaccgtaagggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaatgcaaaataactcatttccaactactgctgcagcattttggtaaaaacctgtagcgattcgttacactggggtgagaagagataagagaaatgaaagagaagagaaatgggacatctaatagtccctaagtgctattaaataccttattggacaagggcttgcttcaagcatctgtattagtctgtattaatgctgctgataaagacgtacccgagactgggaagaaaaagaggtttacttggacttacagttccacatggctggggaggcctcagaatcatggcgggaggtgaaaggcacttcttacatggcagcaagagaaaatgaggaagaagcaaaagtggaaacccctgataagccatcagatcttgtgaaacttattcactatcacaagaatagcatgggaaagactggcccccatgattcaattacctccccttgggtctctcccacaacacgtgggaattctggtagatacaatttcaagttgagatttgggtggggacatagccaaaccatatcattctacccctggcccctccaaatctcatgtcctcactattcaaaaccaatcatgccttcctaaca

SEQ ID NO: 308223 - DNA, 786 bp, Homo sapiens
cggggggggggggggggcggggcgaagccgaggaagagcgttttggggacgggggctggtgaggctcacgttggagggcttcgcgtctgcttcggagaccgtaagggcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggagcggaccgggagtgaacaggcaccactacatgagtgaacgactgaacctgacttaacatacctacgactggtgtatattgacgacgactgactgaccaacgacaccaactagactgcgactaccacttgaccctacttgctgacactttgccacacactcccctagaccacgtacgaactgttcctcaacgcgccctcctcccgtgggttccttatacacacagactggtgaacccccgtggactcacgtggtagcagtctgagcaaacgcacttatgtacggatatctactaggccacaaacacagttagaccagctcgcagtatatatcccgacaaccgttaccctcgaccagtggcaccagagcgacataaacatggggcgttccaaatcgacacccgttagactcacgcccgcacttgtaccagcataactagcaaacgatggatgggggcattgacacgccaacggcacgaaactaccaagtcacaggtaaaaacattggcaacaaggcacgacaa

SEQ ID NO: 308224 - DNA, 1722 bp, Homo sapiens
caacaagttcctcatcttcatctgaggccacctcagcctggactttgttgtccatattgctatcagcatttggggcaaagccattcaacaagtctgtaggaagttccaaactttcccacattttcctgttttcttctgagccctccaaactgttccagcctctgcctgttacccagttccaaagtcacttccacattttgggtatttcttcagcaggtcccaatctactggtaccaatttactgtattagtccgttttcacgctgctgataaagacatacccgagactgggaagaaaaagtggtttaattggacttaaagttccacatggctggggaggcctcagaatcatggtgggaggcaaaagacacttcttacattgtggcaagaaaaaatgaggaagaagcaaaagcagaaacccctgataaactgatcagatctcatgagacttattcactgtcacgagaatagcacgggaaagactggcccccatgattcaattacctccccctgggtctgtcccacaacacgtgggaattctgggagatacaattcaagttgagatttgtggggggacacaaccaaaccatatcagcatcctttcaagaatattagataattggagctgagtactcaggaacttgactgtagtagaatactgctagtttcttaattttaattcacatcacctgaaaagtaaaacaacaggctttgccaagtggatgcttttcagtaacagtgaagtggagtgaataccaaatgtttgccctggtggttcctatctcttcaggcaaacatggtcagtattctgtaaagttcccctggcctaaatgattacttgctctgggcaagtggatatttattaggctatttcaaagccacagcataagaatgtcagcctagccacagagtctgagattctgagttcagcctagccacagagtctaagattctgtatcctctgacattttggaaatgatacactactggcttaagtgatgactctttcagattttcagtattttatacaactactgccacatccttatactttattgcttttctgtcttcttcaacctgggagagaccctgaatttgagtgtgttctctaatcaatagtggtttagctttcttttctatttcactcgtttctagggttttttatttgcagtttaggaactattaggaatgtcaggactttatcagcaggggtaaaactaccacctggcctagcctaagtaggaagtgaaaagataattcaccaaacaatgattaatcagatagaagttctagtcaagagggatattgttgaagttacctcttttagcctagatacatggattcttttcaaatcaggaaagattagaaaaggaacccaaaaaaccctttaacagtgtgaatctttatagtatttgaaaatgagaagaagcagcagattgtaatttggtttattggatgtgatggacgttctgtaatagaaaacctgaaacgatgattgaatgggaaaaagagactacaaaatttgtcgtaggatgtatacagacttattttctttattacagtattataagaaaacatatgtatttgtaaaaatggtttcctgtgtcaagtatttgtgcagtcagagctgacttgtaaactattcttgtaatagctcattattttgaaagatttatatatgatgaattctggatatatgaccaataaaactgatgaagcaaaa

SEQ ID NO: 308225 - DNA, 1382 bp, Homo sapiens
cggggggggggggggggcggggcgaagccgaggaagagcgttttggggacgggggctggtgaggctcacgttggagggcttcgcgtctgcttcggagaccgtaaggacttattcactgtcacgagaatagcacgggaaagactggcccccatgattcaattacctccccctgggtctgtcccacaacacgtgggaattctgggagatacaattcaagttgagatttgtggggggacacaaccaaaccatatcagcatcctttcaagaatattagataattggagctgagtactcaggaacttgactgtagtagaatactgctagtttcttaattttaattcacatcacctgaaaagtaaaacaacaggctttgccaagtggatgcttttcagtaacagtgaagtggagtgaataccaaatgtttgccctggtggttcctatctcttcaggcaaacatggtcagtattctgtaaagttcccctggcctaaatgattacttgctctgggcaagtggatatttattaggctatttcaaagccacagcataagaatgtcagcctagccacagagtctgagattctgagttcagcctagccacagagtctaagattctgtatcctctgacattttggaaatgatacactactggcttaagtgatgactctttcagattttcagtattttatacaactactgccacatccttatactttattgcttttctgtcttcttcaacctgggagagaccctgaatttgagtgtgttctctaatcaatagtggtttagctttcttttctatttcactcgtttctagggttttttatttgcagtttaggaactattaggaatgtcaggactttatcagcaggggtaaaactaccacctggcctagcctaagtaggaagtgaaaagataattcaccaaacaatgattaatcagatagaagttctagtcaagagggatattgttgaagttacctcttttagcctagatacatggattcttttcaaatcaggaaagattagaaaaggaacccaaaaaaccctttaacagtgtgaatctttatagtatttgaaaatgagaagaagcagcagattgtaatttggtttattggatgtgatggacgttctgtaatagaaaacctgaaacgatgattgaatgggaaaaagagactacaaaatttgtcgtaggatgtatacagacttattttctttattacagtattataagaaaacatatgtatttgtaaaaatggtttcctgtgtcaagtatttgtgcagtcagagctgacttgtaaactattcttgtaatagctcattattttgaaagatttatatatgatgaattctggatatatgaccaataaaactgatgaagcaaaa

SEQ ID NO: 308226 - DNA, 1285 bp, Homo sapiens
ctgaggttaactagaggatccccatcgagatcaagtgggaaagactggcccccatgattcaattacctccccctgggtctgtcccacaacacgtgggaattctgggagatacaattcaagttgagatttgtggggggacacaaccaaaccatatcagcatcctttcaagaatattagataattggagctgagtactcaggaacttgactgtagtagaatactgctagtttcttaattttaattcacatcacctgaaaagtaaaacaacaggctttgccaagtggatgcttttcagtaacagtgaagtggagtgaataccaaatgtttgccctggtggttcctatctcttcaggcaaacatggtcagtattctgtaaagttcccctggcctaaatgattacttgctctgggcaagtggatatttattaggctatttcaaagccacagcataagaatgtcagcctagccacagagtctgagattctgagttcagcctagccacagagtctaagattctgtatcctctgacattttggaaatgatacactactggcttaagtgatgactctttcagattttcagtattttatacaactactgccacatccttatactttattgcttttctgtcttcttcaacctgggagagaccctgaatttgagtgtgttctctaatcaatagtggtttagctttcttttctatttcactcgtttctagggttttttatttgcagtttaggaactattaggaatgtcaggactttatcagcaggggtaaaactaccacctggcctagcctaagtaggaagtgaaaagataattcaccaaacaatgattaatcagatagaagttctagtcaagagggatattgttgaagttacctcttttagcctagatacatggattcttttcaaatcaggaaagattagaaaaggaacccaaaaaaccctttaacagtgtgaatctttatagtatttgaaaatgagaagaagcagcagattgtaatttggtttattggatgtgatggacgttctgtaatagaaaacctgaaacgatgattgaatgggaaaaagagactacaaaatttgtcgtaggatgtatacagacttattttctttattacagtattataagaaaacatatgtatttgtaaaaatggtttcctgtgtcaagtatttgtgcagtcagagctgacttgtaaactattcttgtaatagctcattattttgaaagatttatatatgatgaattctggatatatgaccaataaaactgatgaagcaaaa

SEQ ID NO: 308227 - DNA, 2129 bp, Homo sapiens
caacaagttcctcatcttcatctgaggccacctcagcctggactttgttgtccatattgctatcagcatttggggcaaagccattcaacaagtctgtaggaagttccaaactttcccacattttcctgttttcttctgagccctccaaactgttccagcctctgcctgttacccagttccaaagtcacttccacattttgggtatttcttcagcaggtcccaatctactggtaccaatttactgtattagtccgttttcacgctgctgataaagacatacccgagactgggaagaaaaagtggtttaattggacttaaagttccacatggctggggaggcctcagaatcatggtgggaggcaaaagacacttcttacattgtggcaagaaaaaatgaggaagaagcaaaagcagaaacccctgataaactgatcagatctcatgagacttattcactgtcacgagaatagcacgggaaagactggcccccatgattcaattacctccccctgggtctgtcccacaacacgtgggaattctgggagatacaattcaagttgagatttgtggggggacacaaccaaaccatatcagcatcctttcaagaatattagataattggagctgagtactcaggaacttgactgtagtagaatactgctagtttcttaattttaattcacatcacctgaaaagtaaaacaacaggctttgccaagtggatgcttttcagtaacagtgaagtggagtgaataccaaatgtttgccctggtggttcctatctcttcaggcaaacatggtcagtattctgtaaagttcccctggcctaaatgattacttgctctgggcaagtggatatttattaggctatttcaaagccacagcataagaatgtcagcctagccacagagtctgagattctgagttcagcctagccacagagtctaagattctgtatcctctgacattttggaaatgatacactactggcttaagtgatgactctttcagattttcagtattttatacaactactgccacatccttatactttattgcttttctgtcttcttcaacctgggagagaccctgaatttgagtgtgttctctaatcaatagtggtttagctttcttttctatttcactcgtttctagggttttttatttgcagtttaggaactattaggaatgtcaggactttatcagcaggggtaaaactaccacctggcctagcctaagtaggaagtgaaaagataattcaccaaacaatgattaatcagatagaagttctagtcaagagggatattgttgaagttacctcttttagcctagatacatggattcttttcaaatcaggaaagattagaaaaggaacccaaaaaaccctttaacagtgtgaatctttatagtatttgaaaatgagaagaagcagcagattgtaatttggtttattggatgtgatggacgttctgtaatagaaaacctgaaacgatgattgaatgggaaaaagagactacaaaatttgtcgtaggatgtatacagacttattttctttattacagtattataagaaaacatatgtatttgtaaaaatggtttcctgtgtcaagtatttgtgcagtcagagctgacttgtaaactattcttgtaatagctcattattttgaaagatttatatatgatgaattctggatatatgaccaataaaactgatgaagcaaaaaaaaaaaaaaaaaaaaaaaaaaaaaaaaaaaaaaaaaaaaaaaaaaaaaaaaaaaaaaaaaaaaaaaaaaaaaaaaaaaacgcgacaacaaaacaaaaaaaaacacaaaaaagaaaagaaaaaaaaaaaaaacaccaagggccaaaaaacgagcgcgcaaaccggactcaaaagggcaacgacagcacaaccaacgaccacagcatcgaataacgaaggcgaacgaccaaacgacgaccacgaccggacgacgaaaaccgacagaaacgcgaaacacgcgagcaagagagcgacaccacgaggcggagaaaaaaaacaaggggacgaacaagagcaacgcacggaccaactcgacggaacgaaaaaaaccagagcagcaatccgcgaggaacaaaagaaacgagaca

SEQ ID NO: 308228 - DNA, 2125 bp, Homo sapiens
caacaagttcctcatcttcatctgaggccacctcagcctggactttgttgtccatattgctatcagcatttggggcaaagccattcaacaagtctgtaggaagttccaaactttcccacattttcctgttttcttctgagccctccaaactgttccagcctctgcctgttacccagttccaaagtcacttccacattttgggtatttcttcagcaggtcccaatctactggtaccaatttactgtattagtccgttttcacgctgctgataaagacatacccgagactgggaagaaaaagtggtttaattggacttaaagttccacatggctggggaggcctcagaatcatggtgggaggcaaaagacacttcttacattgtggcaagaaaaaatgaggaagaagcaaaagcagaaacccctgataaactgatcagatctcatgagacttattcactgtcacgagaatagcacgggaaagactggcccccatgattcaattacctccccctgggtctgtcccacaacacgtgggaattctgggagatacaattcaagttgagatttgtggggggacacaaccaaaccatatcagcatcctttcaagaatattagataattggagctgagtactcaggaacttgactgtagtagaatactgctagtttcttaattttaattcacatcacctgaaaagtaaaacaacaggctttgccaagtggatgcttttcagtaacagtgaagtggagtgaataccaaatgtttgccctggtggttcctatctcttcaggcaaacatggtcagtattctgtaaagttcccctggcctaaatgattacttgctctgggcaagtggatatttattaggctatttcaaagccacagcataagaatgtcagcctagccacagagtctgagattctgagttcagcctagccacagagtctaagattctgtatcctctgacattttggaaatgatacactactggcttaagtgatgactctttcagattttcagtattttatacaactactgccacatccttatactttattgcttttctgtcttcttcaacctgggagagaccctgaatttgagtgtgttctctaatcaatagtggtttagctttcttttctatttcactcgtttctagggttttttatttgcagtttaggaactattaggaatgtcaggactttatcagcaggggtaaaactaccacctggcctagcctaagtaggaagtgaaaagataattcaccaaacaatgattaatcagatagaagttctagtcaagagggatattgttgaagttacctcttttagcctagatacatggattcttttcaaatcaggaaagattagaaaaggaacccaaaaaaccctttaacagtgtgaatctttatagtatttgaaaatgagaagaagcagcagattgtaatttggtttattggatgtgatggacgttctgtaatagaaaacctgaaacgatgattgaatgggaaaaagagactacaaaatttgtcgtaggatgtatacagacttattttctttattacagtattataagaaaacatatgtatttgtaaaaatggtttcctgtgtcaagtatttgtgcagtcagagctgacttgtaaactattcttgtaatagctcattattttgaaagatttatatatgatgaattctggatatatgaccaataaaactgatgaagcaaaaaaaaaaaaaaaaacaaattgtgggggggttgggccgaaaaaagtttttaaaaccactggtttggggggggggcccctgggtaggaaccgggggaagggggccaagggagaaacgggggcaagacacacgggcgtgggtttctccacccaataaaaaaccccgggcaccgggggctccgtaacaaccggaggagctggagaccacagactatccacgggggccagcagcgaattaaatgccggccgggagaaagacaaaaaacggaaaaagacaaaacaaaatgaagacagaaaccacacaacagataagacaaaaacacagcagcagcgaaacaagcaagacagagcaaacaagaacagcaaccgaaataaactgaaaaaagaacccataccatagtcttgca

SEQ ID NO: 308229 - DNA, 1665 bp, Homo sapiens
  misc_feature (1633)..(1633): n is a, c, g, or t
caacaagttcctcatcttcatctgaggccacctcagcctggactttgttgtccatattgctatcagcatttggggcaaagccattcaacaagtctgtaggaagttccaaactttcccacattttcctgttttcttctgagccctccaaactgttccagcctctgcctgttacccagttccaaagtcacttccacattttgggtatttcttcagcaggtcccaatctactggtaccaatttactgtattagtccgttttcacgctgctgataaagacatacccgagactgggaagaaaaagtggtttaattggacttaaagttccacatggctggggaggcctcagaatcatggtgggaggcaaaagacacttcttacattgtggcaagaaaaaatgaggaagaagcaaaagcagaaacccctgataaactgatcagatctcatgagacttattcactgtcacgagaatagcacgggaaagactggcccccatgattcaattacctccccctgggtctgtcccacaacacgtgggaattctgggagatacaattcaagttgagatttgtggggggacacaaccaaaccatatcagcatcctttcaagaatattagataattggagctgagtactcaggaacttgactgtagtagaatactgctagtttcttaattttaattcacatcacctgaaaagtaaaacaacaggctttgccaagtggatgcttttcagtaacagtgaagtggagtgaataccaaatgtttgccctggtggttcctatctcttcaggcaaacatggtcagtattctgtaaagttcccctggcctaaatgattacttgctctgggcaagtggatatttattaggctatttcaaagccacagcataagaatgtcagcctagccacagagtctgagattctgagttcagcctagccacagagtctaagattctgtatcctctgacattttggaaatgatacactactggcttaagtgatgactctttcagattttcagtattttatacaactactgccacatccttatactttattgcttttctgtcttcttcaacctgggagagaccctgaatttgagtgtgttctctaatcaatagtggtttagctttcttttctatttcactcgtttctagggttttttatttgcagtttaggaactattaggaatgtcaggactttatcagcaggggtaaaactaccacctggcctagcctaagtaggaagtgaaaagataattcaccaaacaatgattaatcagatagaagttctagtcaagagggatattgttgaagttacctcttttagcctagatacatggattcttttcaaatcaggaaagattagaaaaggaacccaaaaaaccctttaacagtgtgaatctttatagtatttgaaaatgagaagaagcagcagattgtaatttggtttattggatgtgatggacgttctgtaatagaaaacctgaaacgatgattgaatgggaaaaagagactacaaaatttgtcgtaggatgtatacagacttattttctttattacagtattataagaaaacatatgtatttgtatcttgtaatagctcattattttgaaagattctcgtgccgaattcngcacgaggtgacctatggtgtggctgctgctg

SEQ ID NO: 308230 - DNA, 1211 bp, Homo sapiens
cggggggggggggggggcggggcgaagccgaggaagagcgttttggggacgggggctggtgaggctcacgttggagggcttcgcgtctgcttcggagaccgtaaggatattgatgaccatgagatccctgctcagaacccccttcctgtgtggcctgctctgggccttttgtgccccaggcgccagggctgaggagcctgcagccagcttctcccaacccggcagcatgggcctggataagaacacagtgcacgaccaagagcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaatgcaaaataactcatttccaactactgctgcagcattttggtaaaaacctgtagcgattcgttacactggggtgagaagagataagagaaatgaaagagaagagaaatgggacatctaatagtccctaagtgctattaaataccttattggacaagggcttgcttcaagcatctgtattagtctgtattaatgctgctgataaagacgtacccgagactgggaagaaaaagaggtttacttggacttacagttccacatggctggggaggcctcagaatcatggcgggaggtgaaaggcacttcttacatggcagcaagagaaaatgaggaagaagcaaaagtggaaacccctgataagccatcagatcttgtgaaacttattcactatcacaagaatagcatgggaaagactggcccccatgattcaattacctccccttgggtctctcccacaacacgtgggaattctggtagatacaatttcaagttgagatttgggtggggacatagccaaaccatatcattctacccctggcccctccaaatctcatgtcctcactattcaaaaccaatcatgccttcctaaca

SEQ ID NO: 308231 - DNA, 1186 bp, Homo sapiens
cggggggggggggggggcggggcgaagccgaggaagagcgttttggggacgggggctggtgaggctcacgttggagggcttcgcgtctgcttcggagaccgtaaggatattgatgaccatgagatccctgctcagaacccccttcctgtgtggcctgctctgggccttttgtgccccaggcgccagggctgaggagcctgcagccagcttctcccaacccggcagcatgggcctggataagaacacagtgcacgaccaagagcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaatgcaaaataactcatttccaactactgctgcagcattttggtaaaaacctgtagcgattcgttacactggggtgagaagagataagagaaatgaaagagaagagaaatgggacatctaatagtccctaagtgctattaaataccttattggacaaggaaaaaaaaaaaaaaaaaaaaaaaaaaaaaaaaaaaaaaaaaaaaaaaaaaaaaaaaaaaaaaaaaaaaaaaaaaaaaaaacgcgacaacaaaacaaaaaaaaacacaaaaaagaaaagaaaaaaaaaaaaaacaccaagggccaaaaaacgagcgcgcaaaccggactcaaaagggcaacgacagcacaaccaacgaccacagcatcgaataacgaaggcgaacgaccaaacgacgaccacgaccggacgacgaaaaccgacagaaacgcgaaacacgcgagcaagagagcgacaccacgaggcggagaaaaaaaacaaggggacgaacaagagcaacgcacggaccaactcgacggaacgaaaaaaaccagagcagcaatccgcgaggaacaaaagaaacgagaca

SEQ ID NO: 308232 - DNA, 565 bp, Homo sapiens
cactttatgttggaagtagaaggagcaattgaggatgtaggataagttaactcctattaaagcacacattttagagatcacagttcataatagtggctacgggccttgctggatctggagatggggaagtagagctggactgggatattgttgaagttacctcttttagcctagatacatggattcttttcaaatcaggaaagattagaaaaggaacccaaaaaaccctttaacagtgtgaatctttatagtatttgaaaatgagaagaagcagcagattgtaatttggtttattggatgtgatggacgttctgtaatagaaaacctgaaacgatgattgaatgggaaaaagagactacaaaatttgtcgtaggatgtatacagacttattttctttattacagtattataagaaaacatatgtatttgtaaaaatggtttcctgtgtcaagtatttgtgcagtcagagctgacttgtaaactattcttgtaatagctcattattttgaaagatttatatatgatgaattctggatatatgaccaataaaactgatgaagcaaaa

SEQ ID NO: 308233 - DNA, 1157 bp, Homo sapiens
cggggggggggggggggcggggcgaagccgaggaagagcgttttggggacgggggctggtgaggctcacgttggagggcttcgcgtctgcttcggagaccgtaaggatattgatgaccatgagatccctgctcagaacccccttcctgtgtggcctgctctgggccttttgtgccccaggcgccagggctgaggagcctgcagccagcttctcccaacccggcagcatgggcctggataagaacacagtgcacgaccaagagcatatcatggagcatctagaaggtgtcatcaacaaaccagaggcggagatgtcgccacaagaattgcagctccattacttcaccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaatgcaaaataactcatttccaactactgctgcagcattttggtaaaaacctgtagcgattcgttacactggggtgagaagagataagagaaatgaaagagaagagaaatgggacatctaatagtccctaagtgctattaaataccttattggacaagggcttgcttcaagcatctgtattagtctgtattaatgctgctgataaagacgtacccgagactgggaagaaaaagaggtttacttggacttacagttccacatggctggggaggcctcagaatcatggcgggaggtgaaaggcacttcttacatggcagcaagagaaaatgaggaagaagcaaaagtggaaacccctgataagccatcagatcttgtgaaacttattcactatcacaagaatagcatgggaaagactggcccccatgattcaattacctccccttgggtctctcccacaacacgtgggaattctggtagatacaatttcaagttgagatttgggtggggacatagccaaaccatatcattctacccctggcccctccaaatctcatgtcctcactattcaaaaccaatcatgccttcctaaca

SEQ ID NO: 308234 - DNA, 587 bp, Homo sapiens
cggggggggggggggggcggggcgaagccgaggaagagcgttttggggacgggggctggtgaggctcacgttggagggcttcgcgtctgcttcggagaccgtaaggatattgatgaccatgagatccctgctcagaacccccttcctgtgtggcctgctctgggccttttgtgccccaggcgccagggctgaggagcctgcagccagcttctcccaacccggcagcatgggcctggataagaacacagtgcacgaccaagagcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggcaaatttgtgcacagagctgaccctcaggaggactggcacttttccaattaaagaagaatgagccataatgaaacaaataagcaaaagcctattttgaagggccttcttttaactggcaaatgtaatttctaaactggattatgataaattgactcaataataca

SEQ ID NO: 308235 - DNA, 398 bp, Homo sapiens
cggggggggggggggggcggggcgaagccgaggaagagcgttttggggacgggggctggtgaggctcacgttggagggcttcgcgtctgcttcggagaccgtaaggatattgatgaccatgagatccctgctcagaacccccttcctgtgtggcctgctctgggccttttgtgccccaggcgccagggctgaggagcctgcagccagcttctcccaacccggcagcatgggcctggataagaacacagtgcacgaccaagagcatatcatggagcatctagaaggtgtcatcaacaaaccagaggcggagatgtcgccacaagaattgcagctccattacttcaaaatgcatgattaataaatcacctcttccgctgttttagctgaagaattaaaaa

SEQ ID NO: 308236 - DNA, 408 bp, Homo sapiens
ggtaggtctggcagtggcttgggggactgtatcacagaaaggcttccctttgttaatttggtccccagtcttgttgacttgtgttgtccttatgtgccaagagtgctgcttctccactgggcatgatggctcgcatctgtaatcccagcactttgggaggccaaagtggaaggatcacttgagccaggagttcaagaccagccttggcaatatagtgagaccctgtctctacaaaacaaacaaaacaaaaattaaaaaattagccaggcctggtagtgcatgcccgtagttctacgtactcaggaggctaaggtgggaggattgcttgagtccaggatgtcgaggctatagtgagccataatcatgccaccgcacttcagcctgggcaacagagtgaggccttgtctc

SEQ ID NO: 308237 - DNA, 359 bp, Homo sapiens
cttttgttttccggcggtgatgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaaaagcaaggcttacagaaggatgttccttcaggaggaagcagcactaaaagcactctgagtcaagatgagtgggaaaccatctcaataaacacattttggataaaaaaaaaaaaa

SEQ ID NO: 308238 - DNA, 392 bp, Homo sapiens
  misc_feature (205)..(205): n is a, c, g, or t
  misc_feature (220)..(220): n is a, c, g, or t
  misc_feature (226)..(226): n is a, c, g, or t
  misc_feature (266)..(267): n is a, c, g, or t
  misc_feature (270)..(270): n is a, c, g, or t
tctgcgtgggggcctgctcccctccttcgttttcatgttgggcattttccccgttgaaattgtttaccgctagttcctatttggaacacataacttctgggcctatcctagcagtctcctcctcaggattcttgacgaaaggtgcgccgcctggacacttagccccgcagacctgcagactgctccccctccgcttcctaatttnggggccgcccctggnccacangtcctcagggccaccgggagcaggtaccaccgccgagaanntcntgccgaattcggcacgagtacagaaggatgttccttcaggaggaagcagcactaaaagcactctgagtcaagatgagtgggaaaccatctcaataaacacattttggataaaaaaaaaaaaa

SEQ ID NO: 308239 - DNA, 910 bp, Homo sapiens
cttttgttttccggcggtgatgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaaaagcaaggcttacagaaggatgttccttcaggaggaagcagcactaaaagcactctgagtcaagatgagtgggaaaccatctcaataaacacattttggataaaaaaaaaaaaaaaaaaaaaaaaaaaaaaaaaaaaaaaaaaaaaaaaaaaaaaaaaaaaaaaaaaaaaaaaaaaaaaccatccggcccgcccaggccaatttaactttagaccaggctaagctaagccatcggacctaaattaaatttaactagtccaatttaccttaaggggagtcaaattaaattgaacggcccttaaattaacaaggccgggaaagccaaaaccttgcccaaaccaaattaaatggcttggaatccaatttcctttaggcgagttgatgaaaaagggaccggcccggaacggattgccttacaagtagcccaactggaaagggaaatggaaatggaacgcgttaatattaggttaaacttccagttaattttaggtaaagcaagttatttactaaacggacggactgaactgggccctttcctttataaataaatggatccgccccgggttggggttggagtgccgtcccagttcgaaacaggaattttatattaaaggaacgtgacacctaaaggggggccactctttatttcaggggccggccccctc

SEQ ID NO: 308240 - DNA, 2927 bp, Homo sapiens
tttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcgaagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttatggctttttactgttagactaatcaaaaataactttaaaaggaacaaagaaactccaacatttcacattatgcatagttatgtagccatttcacagtttctttaagatgtgtaaactcattgtccttgatagtttttatttttcattataaaattataccaggagatttcttttaagattctgagttagcagagttcaaaactattttgtggaaacaagccaactagtaacaatgcagcaacacttctggtttagctaaattatttttccaatgtaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgttcattttgatttattttaaatctttacattcagaaatgagatactgtattatcagaccaggaggcattgctgtgaaagataatttcctattctaaaatatcaaatttaaaataaagataatgaaagaaaacata

SEQ ID NO: 308241 - DNA, 2026 bp, Homo sapiens
tttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcgaagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagagaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgtt

SEQ ID NO: 308242 - DNA, 1230 bp, Homo sapiens
  misc_feature (1020)..(1020): n is a, c, g, or t
tttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcgaagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagatgattancggctcaactaagtagtcatgtcgaccgagggctttcaattgaagcgaaatatgagcggcattaacatgtcaaccccattggccgccatagtgcccgtcagccgggaaggcaccccttgcgtgattttcgtgatgcctggcaagatcctggtcacggatggtcatgtaagcctgtccttttttgacgcgggtagtcctgcttggattttt

SEQ ID NO: 308243 - DNA, 1118 bp, Homo sapiens
tttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcgaagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagggacttgctggaccaaacataaggtttcctacaagggcctggttttaacaacccacacgcactggcagagacaggcagatcagtggggcaggagagagactcagggacatagtgggctaggagctggccattggtaagggggctccatcagcatggagatgagctgtgtagaaaatgacc

SEQ ID NO: 308244 - DNA, 1787 bp, Homo sapiens
tttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcgaagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccaggtagcaaagccgagctctgggcagggggcttcggcgcgctggatagtggaaggggcggggaaagccccctaaaagggcgagcgaaagcaagggcgaggtggggtggggtggggtggggttccgccgcgaggcagctggctgcaggctgcgcgttgtgaggggcctgagggggggcggtgttggcgacggcggagacagagacggaggtggtggtggagcagcaggggaaggaaggaggcgccgcgctcagaatccggctgcggaggcgcggctgtgggcctggagttcctgtggtcgcgctgtcccgggcctgagctggaaggtcagcctcccctggggcgcagacgctgacccttcccggggctcctcccctcccttcaccccatcctctggccttagctggcctgaaattaaggccacggtaataggggtagcaggaggcggcggactgacctaaagcagctggttctttgtgcgcatagaccgtaagggggaatgatctggacttggtcagctgcctcggggcctaggcagggatctgctcatccagatgttcagttgcgttgcccttctttcccttcaatattattaacttaatagtccacttgaagcttgccggcttttttccgggcgacgtggtgtaaacaaccacaacctcgttggtgctgcaacgagctggtggagcccagaaacctttcacatgccagtgtgtcatcctcgtagtaacgtacataacatctccccctaattccacatgcgtgtcatttgtgcatttcttccttgcgattttccctggttcttgttctttgccaagaggattaattatgtagaacatcttggactcaggatatttattagtcgtctcatcagctgatgtgctgagaaaccttcataagccctcaaattgatcacatgtagtaaattgttactataatcataaattgttacattcatcattgcctttctgttccttactatttcattgcttagaatgattttttctttcttccattttatcccttctttttttttttaagtttatcgatttattggcgtacaatacagatgttttgagctatgcaagttaaaattcttctgtaaactttttaagtgctgtgaaaaagacacacatgatcag

SEQ ID NO: 308245 - DNA, 1115 bp, Homo sapiens
ggcaacttggcaagagcccatctctacacacctggctaatttttgtatttttagtagaggcagggtttcaccatgttggccaggcttgtcttgaacttctgacctcaagtgatctggccgccttggccttcaaagtgctgggattataggcgtgagccaccaagcccagtcaaacaaatttttaagtgtatgtaagaacatacaaatttacttaagtgctttatagaatttatagttatcctataatcattttctagcgccagaagaaccactactactgaaggaaagatctttggaatttatttaccttagaaattacttctcgtatgttaagaggttgatgactgctttaagggacctaaaatatagaattaagcattactttctaatgtgacattagaacttttaagcaccgaggtttcttgattcttctaggtgtatgtatggatctatgacccagttcactttaaaacatttgtcatgggattaattcttggtaagtagtgagatgttaatagctataaagtgcaatctaaaatttagaaaacaatatgcagatactgtaaaagaaaatgttcctaaatttaacataaaatagttgtcattttaaaaatactttaaataaagtcagaagataaataatacactaaggaaaatatttgaaacatattaaagatcttttaagagattaacaaactgatagaaaaatggtcaaggtagttaacagataaagaaatacaatgaccaatcatcatgagtgatacttaatcacactcatatacaaattaaagctgtagtgattaagagtcttgcaaaccttaacattaaaggtcttagaaggcagtttgtcagtatctttgaaattttatgtgtctgcagtgacccagcaattctaggctgttcccatacagttgcacaaagtgtgtgcattgacacattatctgtttttttccaaatcccttagactatacttgagtataatctagcaaatatctttcaaattcaaaatgcttataccatttgatctaataaattccactttaaggaatttaccctatgccataatcacagttgcacaaacgtacatgtgcaaggatattatacctagaatagat

SEQ ID NO: 308246 - DNA, 344 bp, Homo sapiens
  misc_feature (88)..(88): n is a, c, g, or t
tcatcagctcgcccgtatgctactgtgtggatcccttcttcttcctaactttcagttcttatctgcaaagtggaaggtcagaccagantatgctctggtactccacagtgctcacctgtatcactgcagggctttctgcactgaaagtggaagcagaaggctaatgggtcacattgtgtaaaggtctctggtgctcaaagtttctaggcaaagaagtgaaaatttggaattctgtcttaactgcgcttttatcccagactggttcatcattacattagggacaaaaaggttggcagttgctggtgttttggttgaataaataatgatgtgcacacagtagcgaa

SEQ ID NO: 308247 - DNA, 5222 bp, Homo sapiens
tttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcgaagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttatggctttttactgttagactaatcaaaaataactttaaaaggaacaaagaaactccaacatttcacattatgcatagttatgtagccatttcacagtttctttaagatgtgtaaactcattgtccttgatagtttttatttttcattataaaattataccaggagatttcttttaagattctgagttagcagagttcaaaactattttgtggaaacaagccaactagtaacaatgcagcaacacttctggtttagctaaattatttttccaatgtaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgttcattttgatttattttaaatctttacattcagaaatgagatactgtattatcagaccaggaggcattgctgtgaaagataatttcctattctaaaatatcaaatttaaaataaagataatgaaagaaaacataagagaactattggactctaattgctttgaactagttttgcagtttgactttacgtcttatacatcttagttacaagtctttggaaactcttgtttacttatgagcataatcattccttggagttatactaactaataatgaatattaaatgatttttcttcagtcacagtgagagcatcttgctttgtggttgaaataggtagtgtatgtcagtctttgctttaggctgtttctcatctaagtgtttgaattaaagatgttaaatttttctaattgtgaaaaatatgttttctgtatcgacacattttattaaacttggcttgattgcttctttatagtagtccctgtaagtggacataaatgtggctatttgatgttaatgcaactatgtcaaggctgcaatcactttaatagtttctttttagcaaataaatgttcattgatgaagtgcctgggtattttcccgtcccatttgcagagctctactacttcatttccacagtaagcatatatataatgatcacttctgagtttatcaccagtaacattgatacctattttggggtataaacatggtgtttttcagaaataaaaattatttcattaacctttactattactgtgataatacccaggcactcaatattcatcctgaaattttttataatatatgtaatttgtctagtcttaaagacatttggagcatggccaacaggaaggtcagcttcttactgatgtgtgtggattcttacagaatgttagtacaaatttttataaatatttggtgatccctggggggaaatatcattcttactatggttagaaagtgaattagaaatttcagctcagtttctattttactattcaagttgtgtactttaaacaaatataaaaatcaaaaggctgcctctattacaatcctcagtggaatagatggctatctttcttggctaacattaaatattcttgtaccagagcatggaaaatcgtttataattgttaatagaatggcgatttttttttaagaacttcagatttgctatgctgctgtaagtagaaagcatgaagctttttgatcatgtagggcttattgtagagggtatcaattggcctaactaagcaggattgaatttaccagaggctaagttcagatagtaagaataatgcatatgtgattgttcttaaagtcaatgtattaaataaggtatttttccttttccctcttactggatttttcaattttcaaaccatatggcctaggtaactttaattgaaataatatagatttagttgaatactattcaggaagtaataaattttaatatatcacattgaaattatgcagtggtgatgaattttggtgtttcccccctctttctggttttacatcatgaggatcagttagctgctgacaagaaaagtcatcttgtgtcttttgtaaattgaattttttttttaaatctattaggaactggaaaacagcaagtatggttgattctcattattcaaggtagttacgttctataaagtcactgcgaacactgaattagcaaatatagaacctaggggaaatacaaggctagatttctgcaagccactggtcacattttcatcaagcagtcaacatgtaaatttctgttgtaaagacaccttatttaatataatcgattcattaacattgaagtcatgaccaacaacactgtaactcatgcctgaatgaagcttatctgacacataagcttcataaggcacacaacagcctttttacccttaggaacagctttttgcccttagcactatgcttgggggccattttaaacagtgaaatcaaaaaaagaacagaaatgcaaaaaccatggcattagcgtaaaaaggacacgtttatagtatgaaagctggaacatggccttgttcaacctcagctcagaatatgtgtacagcaagttttttgctgtaccacaaaattttaggttaggcaaattcacaaatacggaatccatgaataacgaggatcaactgtacttaactatattttaaagctgtgacatttatctacctggtttatggaatagaatttattgctgaatcatgctccagtatttgagtgatgttttaaatatcctatgtctgaaaataattcctcctaattgtgtggtaatttgcttttactgtttccacagtatttcaggtctttgctcattcactcagtaatactgagcacttaccatgtaccagaattttactaggcacaaccatgaataaaaatacaattctcttgcaccattaaaaaaaaag

SEQ ID NO: 308248 - DNA, 4616 bp, Homo sapiens
tttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcgaagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttatggctttttactgttagactaatcaaaaataactttaaaaggaacaaagaaactccaacatttcacattatgcatagttatgtagccatttcacagtttctttaagatgtgtaaactcattgtccttgatagtttttatttttcattataaaattataccaggagatttcttttaagattctgagttagcagagttcaaaactattttgtggaaacaagccaactagtaacaatgcagcaacacttctggtttagctaaattatttttccaatgtaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgttcattttgatttattttaaatctttacattcagaaatgagatactgtattatcagaccaggaggcattgctgtgaaagataatttcctattctaaaatatcaaatttaaaataaagataatgaaagaaaacataagagaactattggactctaattgctttgaactagttttgcagtttgactttacgtcttatacatcttagttacaagtctttggaaactcttgtttacttatgagcataatcattccttggagttatactaactaataatgaatattaaatgatttttcttcagtcacagtgagagcatcttgctttgtggttgaaataggtagtgtatgtcagtctttgctttaggctgtttctcatctaagtgtttgaattaaagatgttaaatttttctaattgtgaaaaatatgttttctgtatcgacacattttattaaacttggcttgattgcttctttatagtagtccctgtaagtggacataaatgtggctatttgatgttaatgcaactatgtcaaggctgcaatcactttaatagtttctttttagcaaataaatgttcattgatgaagtgcctgggtattttcccgtcccatttgcagagctctactacttcatttccacagtaagcatatatataatgatcacttctgagtttatcaccagtaacattgatacctattttggggtataaacatggtgtttttcagaaataaaaattatttcattaacctttactattactgtgataatacccaggcactcaatattcatcctgaaattttttataatatatgtaatttgtctagtcttaaagacatttggagcatggccaacaggaaggtcagcttcttactgatgtgtgtggattcttacagaatgttagtacaaatttttataaatatttggtgatccctggggggaaatatcattcttactatggttagaaagtgaattagaaatttcagctcagtttctattttactattcaagttgtgtactttaaacaaatataaaaatcaaaaggctgcctctattacaatcctcagtggaatagatggctatctttcttggctaacattaaatattcttgtaccagagcatggaaaatcgtttataattgttaatagaatggcgatttttttttaagaacttcagatttgctatgctgctgtaagtagaaagcatgaagctttttgatcatgtagggcttattgtagagggtatcaattggcctaactaagcaggattgaatttaccagaggctaagttcagatagtaagaataatgcatatgtgattgttcttaaagtcaatgtattaaataaggtatttttccttttccctcttactggatttttcaattttcaaaccatatggcctaggtaactttaattgaaataatatagatttagttgaatactattcaggaagtaataaattttaatatatcacattgaaattatgcagtggtgatgaattttggtgtttcccccctctttctggttttacatcatgaggatcagttagctgctgacaagaaaagtcatcttgtgtcttttgtaaattgaattttttttttaaatctattaggaactggaaaacagcaagtatggttgattctcattattcaaggtagttacgttctataaagtcactgcgaacactgaattagcaaatatagaacctaggggaaatacaaggctagatttctgcaagccactggtcacatgttgactgcttgatgaaaatgtgaccagtggcttgcagaaatctagccttgtatttcccctaggttctatatttggtcgagc

SEQ ID NO: 308249 - DNA, 4405 bp, Homo sapiens
  misc_feature (4369)..(4369): n is a, c, g, or t
  misc_feature (4404)..(4404): n is a, c, g, or t
tttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcgaagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttatggctttttactgttagactaatcaaaaataactttaaaaggaacaaagaaactccaacatttcacattatgcatagttatgtagccatttcacagtttctttaagatgtgtaaactcattgtccttgatagtttttatttttcattataaaattataccaggagatttcttttaagattctgagttagcagagttcaaaactattttgtggaaacaagccaactagtaacaatgcagcaacacttctggtttagctaaattatttttccaatgtaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgttcattttgatttattttaaatctttacattcagaaatgagatactgtattatcagaccaggaggcattgctgtgaaagataatttcctattctaaaatatcaaatttaaaataaagataatgaaagaaaacataagagaactattggactctaattgctttgaactagttttgcagtttgactttacgtcttatacatcttagttacaagtctttggaaactcttgtttacttatgagcataatcattccttggagttatactaactaataatgaatattaaatgatttttcttcagtcacagtgagagcatcttgctttgtggttgaaataggtagtgtatgtcagtctttgctttaggctgtttctcatctaagtgtttgaattaaagatgttaaatttttctaattgtgaaaaatatgttttctgtatcgacacattttattaaacttggcttgattgcttctttatagtagtccctgtaagtggacataaatgtggctatttgatgttaatgcaactatgtcaaggctgcaatcactttaatagtttctttttagcaaataaatgttcattgatgaagtgcctgggtattttcccgtcccatttgcagagctctactacttcatttccacagtaagcatatatataatgatcacttctgagtttatcaccagtaacattgatacctattttggggtataaacatggtgtttttcagaaataaaaattatttcattaacctttactattactgtgataatacccaggcactcaatattcatcctgaaattttttataatatatgtaatttgtctagtcttaaagacatttggagcatggccaacaggaaggtcagcttcttactgatgtgtgtggattcttacagaatgttagtacaaatttttataaatatttggtgatccctggggggaaatatcattcttactatggttagaaagtgaattagaaatttcagctcagtttctattttactattcaagttgtgtactttaaacaaatataaaaatcaaaaggctgcctctattacaatcctcagtggaatagatggctatctttcttggctaacattaaatattcttgtaccagagcatggaaaatcgtttataattgttaatagaatggcgatttttttttaagaacttcagatttgctatgctgctgtaagtagaaagcatgaagctttttgatcatgtagggcttattgtagagggtatcaattggcctaactaagcaggattgaatttaccagaggctaagttcagatagtaagaataatgcatatgtgattgttcttaaagtcaatgtattaaataaggtatttttccttttccctcttactggatttttcaattttcaaaccatatggcctaggtaactttaattgaaataatatagatttagttgaatactattcaggaagtaataaattttaatatatcacattgaaattatgcagtggtgatgaattttggtgtttcccccctctttctggttttacatcatgaggatcagttagctgctgttttccagttcctaatagatttaaaaaaaanattcaatttacaaaagacacaagatgacttttctng

SEQ ID NO: 308250 - DNA, 4894 bp, Homo sapiens
  misc_feature (1935)..(1935): n is a, c, g, or t
  misc_feature (1965)..(1965): n is a, c, g, or t
  misc_feature (1996)..(1996): n is a, c, g, or t
  misc_feature (1998)..(1998): n is a, c, g, or t
tttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcgaagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatggctgcagtgctctgagccctaggattcatctttcttttcaccgtaggtggcctgactggcattgtattagcaaactcatcactagacatcgtactacacgacacgtactacgttgtagctcacttccactatgtcctatcaataggagctgtatttgccatcataggaggcttcattcactgatttcccctattctcaggctacaccctagaccaaacctacgccanaatccatcactatcatattcatcggcgtanatctaactttcttcccacaacactttctcgncntatcggaatgccccgacaagccaactagtaacaatgcagcaacacttctggtttagctaaattatttttccaatgtaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgttcattttgatttattttaaatctttacattcagaaatgagatactgtattatcagaccaggaggcattgctgtgaaagataatttcctattctaaaatatcaaatttaaaataaagataatgaaagaaaacataagagaactattggactctaattgctttgaactagttttgcagtttgactttacgtcttatacatcttagttacaagtctttggaaactcttgtttacttatgagcataatcattccttggagttatactaactaataatgaatattaaatgatttttcttcagtcacagtgagagcatcttgctttgtggttgaaataggtagtgtatgtcagtctttgctttaggctgtttctcatctaagtgtttgaattaaagatgttaaatttttctaattgtgaaaaatatgttttctgtatcgacacattttattaaacttggcttgattgcttctttatagtagtccctgtaagtggacataaatgtggctatttgatgttaatgcaactatgtcaaggctgcaatcactttaatagtttctttttagcaaataaatgttcattgatgaagtgcctgggtattttcccgtcccatttgcagagctctactacttcatttccacagtaagcatatatataatgatcacttctgagtttatcaccagtaacattgatacctattttggggtataaacatggtgtttttcagaaataaaaattatttcattaacctttactattactgtgataatacccaggcactcaatattcatcctgaaattttttataatatatgtaatttgtctagtcttaaagacatttggagcatggccaacaggaaggtcagcttcttactgatgtgtgtggattcttacagaatgttagtacaaatttttataaatatttggtgatccctggggggaaatatcattcttactatggttagaaagtgaattagaaatttcagctcagtttctattttactattcaagttgtgtactttaaacaaatataaaaatcaaaaggctgcctctattacaatcctcagtggaatagatggctatctttcttggctaacattaaatattcttgtaccagagcatggaaaatcgtttataattgttaatagaatggcgatttttttttaagaacttcagatttgctatgctgctgtaagtagaaagcatgaagctttttgatcatgtagggcttattgtagagggtatcaattggcctaactaagcaggattgaatttaccagaggctaagttcagatagtaagaataatgcatatgtgattgttcttaaagtcaatgtattaaataaggtatttttccttttccctcttactggatttttcaattttcaaaccatatggcctaggtaactttaattgaaataatatagatttagttgaatactattcaggaagtaataaattttaatatatcacattgaaattatgcagtggtgatgaattttggtgtttcccccctctttctggttttacatcatgaggatcagttagctgctgacaagaaaagtcatcttgtgtcttttgtaaattgaattttttttttaaatctattaggaactggaaaacagcaagtatggttgattctcattattcaaggtagttacgttctataaagtcactgcgaacactgaattagcaaatatagaacctaggggaaatacaaggctagatttctgcaagccactggtcacattttcatcaagcagtcaacatgtaaatttctgttgtaaagacaccttatttaatataatcgattcattaacattgaagtcatgaccaacaacactgtaactcatgcctgaatgaagcttatctgacacataagcttcataaggcacacaacagcctttttacccttaggaacagctttttgcccttagcactatgcttgggggccattttaaacagtgaaatcaaaaaaagaacagaaatgcaaaaaccatggcattagcgtaaaaaggacacgtttatagtatgaaagctggaacatggccttgttcaacctcagctcagaatatgtgtacagcaagttttttgctgtaccacaaaattttaggttaggcaaattcacaaatacggaatccatgaataacgaggatcaactgtacttaactatattttaaagctgtgacatttatctacctggtttatggaatagaatttattgctgaatcatgctccagtatttgagtgatgttttaaatatcctatgtctgaaaataattcctcctaattgtgtggtaatttgcttttactgtttccacagtatttcaggtctttgctcattcactcagtaatactgagcacttaccatgtaccagaattttactaggcacaaccatgaataaaaatacaattctcttgcaccattaaaaaaaaag

SEQ ID NO: 308251 - DNA, 5319 bp, Homo sapiens
tttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcgaagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccagtataatttcagattctcgtgtcccatcgaagtttctagcaagaggactgttgtcacatttccttcttggactcattactggtcactgaaaaccagaagaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttatggctttttactgttagactaatcaaaaataactttaaaaggaacaaagaaactccaacatttcacattatgcatagttatgtagccatttcacagtttctttaagatgtgtaaactcattgtccttgatagtttttatttttcattataaaattataccaggagatttcttttaagattctgagttagcagagttcaaaactattttgtggaaacaagccaactagtaacaatgcagcaacacttctggtttagctaaattatttttccaatgtaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgttcattttgatttattttaaatctttacattcagaaatgagatactgtattatcagaccaggaggcattgctgtgaaagataatttcctattctaaaatatcaaatttaaaataaagataatgaaagaaaacataagagaactattggactctaattgctttgaactagttttgcagtttgactttacgtcttatacatcttagttacaagtctttggaaactcttgtttacttatgagcataatcattccttggagttatactaactaataatgaatattaaatgatttttcttcagtcacagtgagagcatcttgctttgtggttgaaataggtagtgtatgtcagtctttgctttaggctgtttctcatctaagtgtttgaattaaagatgttaaatttttctaattgtgaaaaatatgttttctgtatcgacacattttattaaacttggcttgattgcttctttatagtagtccctgtaagtggacataaatgtggctatttgatgttaatgcaactatgtcaaggctgcaatcactttaatagtttctttttagcaaataaatgttcattgatgaagtgcctgggtattttcccgtcccatttgcagagctctactacttcatttccacagtaagcatatatataatgatcacttctgagtttatcaccagtaacattgatacctattttggggtataaacatggtgtttttcagaaataaaaattatttcattaacctttactattactgtgataatacccaggcactcaatattcatcctgaaattttttataatatatgtaatttgtctagtcttaaagacatttggagcatggccaacaggaaggtcagcttcttactgatgtgtgtggattcttacagaatgttagtacaaatttttataaatatttggtgatccctggggggaaatatcattcttactatggttagaaagtgaattagaaatttcagctcagtttctattttactattcaagttgtgtactttaaacaaatataaaaatcaaaaggctgcctctattacaatcctcagtggaatagatggctatctttcttggctaacattaaatattcttgtaccagagcatggaaaatcgtttataattgttaatagaatggcgatttttttttaagaacttcagatttgctatgctgctgtaagtagaaagcatgaagctttttgatcatgtagggcttattgtagagggtatcaattggcctaactaagcaggattgaatttaccagaggctaagttcagatagtaagaataatgcatatgtgattgttcttaaagtcaatgtattaaataaggtatttttccttttccctcttactggatttttcaattttcaaaccatatggcctaggtaactttaattgaaataatatagatttagttgaatactattcaggaagtaataaattttaatatatcacattgaaattatgcagtggtgatgaattttggtgtttcccccctctttctggttttacatcatgaggatcagttagctgctgacaagaaaagtcatcttgtgtcttttgtaaattgaattttttttttaaatctattaggaactggaaaacagcaagtatggttgattctcattattcaaggtagttacgttctataaagtcactgcgaacactgaattagcaaatatagaacctaggggaaatacaaggctagatttctgcaagccactggtcacattttcatcaagcagtcaacatgtaaatttctgttgtaaagacaccttatttaatataatcgattcattaacattgaagtcatgaccaacaacactgtaactcatgcctgaatgaagcttatctgacacataagcttcataaggcacacaacagcctttttacccttaggaacagctttttgcccttagcactatgcttgggggccattttaaacagtgaaatcaaaaaaagaacagaaatgcaaaaaccatggcattagcgtaaaaaggacacgtttatagtatgaaagctggaacatggccttgttcaacctcagctcagaatatgtgtacagcaagttttttgctgtaccacaaaattttaggttaggcaaattcacaaatacggaatccatgaataacgaggatcaactgtacttaactatattttaaagctgtgacatttatctacctggtttatggaatagaatttattgctgaatcatgctccagtatttgagtgatgttttaaatatcctatgtctgaaaataattcctcctaattgtgtggtaatttgcttttactgtttccacagtatttcaggtctttgctcattcactcagtaatactgagcacttaccatgtaccagaattttactaggcacaaccatgaataaaaatacaattctcttgcaccattaaaaaaaaag

SEQ ID NO: 308252 - DNA, 5429 bp, Homo sapiens
tttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcgaagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccagaggctgtggagtaatgtgacagtggcagagagctaaaacttgagccaaactgcctgtttgtaccccacctccaccaattattggctgagtaactttgagcaagttaatttttacctccctgtctgcatcggtaagaaaacatatttacctcaaaaaaaaaaaaagcaagaaaaaagaaaaactttaagattgctgtgaaaataataggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttatggctttttactgttagactaatcaaaaataactttaaaaggaacaaagaaactccaacatttcacattatgcatagttatgtagccatttcacagtttctttaagatgtgtaaactcattgtccttgatagtttttatttttcattataaaattataccaggagatttcttttaagattctgagttagcagagttcaaaactattttgtggaaacaagccaactagtaacaatgcagcaacacttctggtttagctaaattatttttccaatgtaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgttcattttgatttattttaaatctttacattcagaaatgagatactgtattatcagaccaggaggcattgctgtgaaagataatttcctattctaaaatatcaaatttaaaataaagataatgaaagaaaacataagagaactattggactctaattgctttgaactagttttgcagtttgactttacgtcttatacatcttagttacaagtctttggaaactcttgtttacttatgagcataatcattccttggagttatactaactaataatgaatattaaatgatttttcttcagtcacagtgagagcatcttgctttgtggttgaaataggtagtgtatgtcagtctttgctttaggctgtttctcatctaagtgtttgaattaaagatgttaaatttttctaattgtgaaaaatatgttttctgtatcgacacattttattaaacttggcttgattgcttctttatagtagtccctgtaagtggacataaatgtggctatttgatgttaatgcaactatgtcaaggctgcaatcactttaatagtttctttttagcaaataaatgttcattgatgaagtgcctgggtattttcccgtcccatttgcagagctctactacttcatttccacagtaagcatatatataatgatcacttctgagtttatcaccagtaacattgatacctattttggggtataaacatggtgtttttcagaaataaaaattatttcattaacctttactattactgtgataatacccaggcactcaatattcatcctgaaattttttataatatatgtaatttgtctagtcttaaagacatttggagcatggccaacaggaaggtcagcttcttactgatgtgtgtggattcttacagaatgttagtacaaatttttataaatatttggtgatccctggggggaaatatcattcttactatggttagaaagtgaattagaaatttcagctcagtttctattttactattcaagttgtgtactttaaacaaatataaaaatcaaaaggctgcctctattacaatcctcagtggaatagatggctatctttcttggctaacattaaatattcttgtaccagagcatggaaaatcgtttataattgttaatagaatggcgatttttttttaagaacttcagatttgctatgctgctgtaagtagaaagcatgaagctttttgatcatgtagggcttattgtagagggtatcaattggcctaactaagcaggattgaatttaccagaggctaagttcagatagtaagaataatgcatatgtgattgttcttaaagtcaatgtattaaataaggtatttttccttttccctcttactggatttttcaattttcaaaccatatggcctaggtaactttaattgaaataatatagatttagttgaatactattcaggaagtaataaattttaatatatcacattgaaattatgcagtggtgatgaattttggtgtttcccccctctttctggttttacatcatgaggatcagttagctgctgacaagaaaagtcatcttgtgtcttttgtaaattgaattttttttttaaatctattaggaactggaaaacagcaagtatggttgattctcattattcaaggtagttacgttctataaagtcactgcgaacactgaattagcaaatatagaacctaggggaaatacaaggctagatttctgcaagccactggtcacattttcatcaagcagtcaacatgtaaatttctgttgtaaagacaccttatttaatataatcgattcattaacattgaagtcatgaccaacaacactgtaactcatgcctgaatgaagcttatctgacacataagcttcataaggcacacaacagcctttttacccttaggaacagctttttgcccttagcactatgcttgggggccattttaaacagtgaaatcaaaaaaagaacagaaatgcaaaaaccatggcattagcgtaaaaaggacacgtttatagtatgaaagctggaacatggccttgttcaacctcagctcagaatatgtgtacagcaagttttttgctgtaccacaaaattttaggttaggcaaattcacaaatacggaatccatgaataacgaggatcaactgtacttaactatattttaaagctgtgacatttatctacctggtttatggaatagaatttattgctgaatcatgctccagtatttgagtgatgttttaaatatcctatgtctgaaaataattcctcctaattgtgtggtaatttgcttttactgtttccacagtatttcaggtctttgctcattcactcagtaatactgagcacttaccatgtaccagaattttactaggcacaaccatgaataaaaatacaattctcttgcaccattaaaaaaaaag

SEQ ID NO: 308253 - DNA, 4625 bp, Homo sapiens
tcggtacccctcaacgctttatacttccaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttatggctttttactgttagactaatcaaaaataactttaaaaggaacaaagaaactccaacatttcacattatgcatagttatgtagccatttcacagtttctttaagatgtgtaaactcattgtccttgatagtttttatttttcattataaaattataccaggagatttcttttaagattctgagttagcagagttcaaaactattttgtggaaacaagccaactagtaacaatgcagcaacacttctggtttagctaaattatttttccaatgtaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgttcattttgatttattttaaatctttacattcagaaatgagatactgtattatcagaccaggaggcattgctgtgaaagataatttcctattctaaaatatcaaatttaaaataaagataatgaaagaaaacataagagaactattggactctaattgctttgaactagttttgcagtttgactttacgtcttatacatcttagttacaagtctttggaaactcttgtttacttatgagcataatcattccttggagttatactaactaataatgaatattaaatgatttttcttcagtcacagtgagagcatcttgctttgtggttgaaataggtagtgtatgtcagtctttgctttaggctgtttctcatctaagtgtttgaattaaagatgttaaatttttctaattgtgaaaaatatgttttctgtatcgacacattttattaaacttggcttgattgcttctttatagtagtccctgtaagtggacataaatgtggctatttgatgttaatgcaactatgtcaaggctgcaatcactttaatagtttctttttagcaaataaatgttcattgatgaagtgcctgggtattttcccgtcccatttgcagagctctactacttcatttccacagtaagcatatatataatgatcacttctgagtttatcaccagtaacattgatacctattttggggtataaacatggtgtttttcagaaataaaaattatttcattaacctttactattactgtgataatacccaggcactcaatattcatcctgaaattttttataatatatgtaatttgtctagtcttaaagacatttggagcatggccaacaggaaggtcagcttcttactgatgtgtgtggattcttacagaatgttagtacaaatttttataaatatttggtgatccctggggggaaatatcattcttactatggttagaaagtgaattagaaatttcagctcagtttctattttactattcaagttgtgtactttaaacaaatataaaaatcaaaaggctgcctctattacaatcctcagtggaatagatggctatctttcttggctaacattaaatattcttgtaccagagcatggaaaatcgtttataattgttaatagaatggcgatttttttttaagaacttcagatttgctatgctgctgtaagtagaaagcatgaagctttttgatcatgtagggcttattgtagagggtatcaattggcctaactaagcaggattgaatttaccagaggctaagttcagatagtaagaataatgcatatgtgattgttcttaaagtcaatgtattaaataaggtatttttccttttccctcttactggatttttcaattttcaaaccatatggcctaggtaactttaattgaaataatatagatttagttgaatactattcaggaagtaataaattttaatatatcacattgaaattatgcagtggtgatgaattttggtgtttcccccctctttctggttttacatcatgaggatcagttagctgctgacaagaaaagtcatcttgtgtcttttgtaaattgaattttttttttaaatctattaggaactggaaaacagcaagtatggttgattctcattattcaaggtagttacgttctataaagtcactgcgaacactgaattagcaaatatagaacctaggggaaatacaaggctagatttctgcaagccactggtcacattttcatcaagcagtcaacatgtaaatttctgttgtaaagacaccttatttaatataatcgattcattaacattgaagtcatgaccaacaacactgtaactcatgcctgaatgaagcttatctgacacataagcttcataaggcacacaacagcctttttacccttaggaacagctttttgcccttagcactatgcttgggggccattttaaacagtgaaatcaaaaaaagaacagaaatgcaaaaaccatggcattagcgtaaaaaggacacgtttatagtatgaaagctggaacatggccttgttcaacctcagctcagaatatgtgtacagcaagttttttgctgtaccacaaaattttaggttaggcaaattcacaaatacggaatccatgaataacgaggatcaactgtacttaactatattttaaagctgtgacatttatctacctggtttatggaatagaatttattgctgaatcatgctccagtatttgagtgatgttttaaatatcctatgtctgaaaataattcctcctaattgtgtggtaatttgcttttactgtttccacagtatttcaggtctttgctcattcactcagtaatactgagcacttaccatgtaccagaattttactaggcacaaccatgaataaaaatacaattctcttgcaccattaaaaaaaaag

SEQ ID NO: 308254 - DNA, 5060 bp, Homo sapiens
aagatcagtagaagtttctaattatactgttcttaatctttcaagagttagtgttattcctctgacgtgggtatacagtattttattagattgtatattgaaattgtctgtcagatttgtacttacagaactccttagatttacacttgacagtacaattttatgcccttcaatacacattgttttacaattccagttgctctttaatattgttgtaagggctatataattcaccttttgaatagctgctcttatttagttgtgatcttatattaaacagaggctgtggagtaatgtgacagtggcagagagctaaaacttgagccaaactgcctgtttgtaccccacctccaccaattattggctgagtaactttgagcaagttaatttttacctccctgtctgcatcggtaagaaaacatatttacctcaaaaaaaaaaaaagcaagaaaaaagaaaaactttaagattgctgtgaaaataataggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttatggctttttactgttagactaatcaaaaataactttaaaaggaacaaagaaactccaacatttcacattatgcatagttatgtagccatttcacagtttctttaagatgtgtaaactcattgtccttgatagtttttatttttcattataaaattataccaggagatttcttttaagattctgagttagcagagttcaaaactattttgtggaaacaagccaactagtaacaatgcagcaacacttctggtttagctaaattatttttccaatgtaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgttcattttgatttattttaaatctttacattcagaaatgagatactgtattatcagaccaggaggcattgctgtgaaagataatttcctattctaaaatatcaaatttaaaataaagataatgaaagaaaacataagagaactattggactctaattgctttgaactagttttgcagtttgactttacgtcttatacatcttagttacaagtctttggaaactcttgtttacttatgagcataatcattccttggagttatactaactaataatgaatattaaatgatttttcttcagtcacagtgagagcatcttgctttgtggttgaaataggtagtgtatgtcagtctttgctttaggctgtttctcatctaagtgtttgaattaaagatgttaaatttttctaattgtgaaaaatatgttttctgtatcgacacattttattaaacttggcttgattgcttctttatagtagtccctgtaagtggacataaatgtggctatttgatgttaatgcaactatgtcaaggctgcaatcactttaatagtttctttttagcaaataaatgttcattgatgaagtgcctgggtattttcccgtcccatttgcagagctctactacttcatttccacagtaagcatatatataatgatcacttctgagtttatcaccagtaacattgatacctattttggggtataaacatggtgtttttcagaaataaaaattatttcattaacctttactattactgtgataatacccaggcactcaatattcatcctgaaattttttataatatatgtaatttgtctagtcttaaagacatttggagcatggccaacaggaaggtcagcttcttactgatgtgtgtggattcttacagaatgttagtacaaatttttataaatatttggtgatccctggggggaaatatcattcttactatggttagaaagtgaattagaaatttcagctcagtttctattttactattcaagttgtgtactttaaacaaatataaaaatcaaaaggctgcctctattacaatcctcagtggaatagatggctatctttcttggctaacattaaatattcttgtaccagagcatggaaaatcgtttataattgttaatagaatggcgatttttttttaagaacttcagatttgctatgctgctgtaagtagaaagcatgaagctttttgatcatgtagggcttattgtagagggtatcaattggcctaactaagcaggattgaatttaccagaggctaagttcagatagtaagaataatgcatatgtgattgttcttaaagtcaatgtattaaataaggtatttttccttttccctcttactggatttttcaattttcaaaccatatggcctaggtaactttaattgaaataatatagatttagttgaatactattcaggaagtaataaattttaatatatcacattgaaattatgcagtggtgatgaattttggtgtttcccccctctttctggttttacatcatgaggatcagttagctgctgacaagaaaagtcatcttgtgtcttttgtaaattgaattttttttttaaatctattaggaactggaaaacagcaagtatggttgattctcattattcaaggtagttacgttctataaagtcactgcgaacactgaattagcaaatatagaacctaggggaaatacaaggctagatttctgcaagccactggtcacattttcatcaagcagtcaacatgtaaatttctgttgtaaagacaccttatttaatataatcgattcattaacattgaagtcatgaccaacaacactgtaactcatgcctgaatgaagcttatctgacacataagcttcataaggcacacaacagcctttttacccttaggaacagctttttgcccttagcactatgcttgggggccattttaaacagtgaaatcaaaaaaagaacagaaatgcaaaaaccatggcattagcgtaaaaaggacacgtttatagtatgaaagctggaacatggccttgttcaacctcagctcagaatatgtgtacagcaagttttttgctgtaccacaaaattttaggttaggcaaattcacaaatacggaatccatgaataacgaggatcaactgtacttaactatattttaaagctgtgacatttatctacctggtttatggaatagaatttattgctgaatcatgctccagtatttgagtgatgttttaaatatcctatgtctgaaaataattcctcctaattgtgtggtaatttgcttttactgtttccacagtatttcaggtctttgctcattcactcagtaatactgagcacttaccatgtaccagaattttactaggcacaaccatgaataaaaatacaattctcttgcaccattaaaaaaaaag

SEQ ID NO: 308255 - DNA, 4722 bp, Homo sapiens
cgtttttgtggttagctccttcttgccaaccaaccatgagctcccagattcgtcagaattattccaccgacgtggaggcagccgtcaacagcctggtcaatttgtacctgcaggctgttttgtagccagtattcttctccttgctgttggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttatggctttttactgttagactaatcaaaaataactttaaaaggaacaaagaaactccaacatttcacattatgcatagttatgtagccatttcacagtttctttaagatgtgtaaactcattgtccttgatagtttttatttttcattataaaattataccaggagatttcttttaagattctgagttagcagagttcaaaactattttgtggaaacaagccaactagtaacaatgcagcaacacttctggtttagctaaattatttttccaatgtaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgttcattttgatttattttaaatctttacattcagaaatgagatactgtattatcagaccaggaggcattgctgtgaaagataatttcctattctaaaatatcaaatttaaaataaagataatgaaagaaaacataagagaactattggactctaattgctttgaactagttttgcagtttgactttacgtcttatacatcttagttacaagtctttggaaactcttgtttacttatgagcataatcattccttggagttatactaactaataatgaatattaaatgatttttcttcagtcacagtgagagcatcttgctttgtggttgaaataggtagtgtatgtcagtctttgctttaggctgtttctcatctaagtgtttgaattaaagatgttaaatttttctaattgtgaaaaatatgttttctgtatcgacacattttattaaacttggcttgattgcttctttatagtagtccctgtaagtggacataaatgtggctatttgatgttaatgcaactatgtcaaggctgcaatcactttaatagtttctttttagcaaataaatgttcattgatgaagtgcctgggtattttcccgtcccatttgcagagctctactacttcatttccacagtaagcatatatataatgatcacttctgagtttatcaccagtaacattgatacctattttggggtataaacatggtgtttttcagaaataaaaattatttcattaacctttactattactgtgataatacccaggcactcaatattcatcctgaaattttttataatatatgtaatttgtctagtcttaaagacatttggagcatggccaacaggaaggtcagcttcttactgatgtgtgtggattcttacagaatgttagtacaaatttttataaatatttggtgatccctggggggaaatatcattcttactatggttagaaagtgaattagaaatttcagctcagtttctattttactattcaagttgtgtactttaaacaaatataaaaatcaaaaggctgcctctattacaatcctcagtggaatagatggctatctttcttggctaacattaaatattcttgtaccagagcatggaaaatcgtttataattgttaatagaatggcgatttttttttaagaacttcagatttgctatgctgctgtaagtagaaagcatgaagctttttgatcatgtagggcttattgtagagggtatcaattggcctaactaagcaggattgaatttaccagaggctaagttcagatagtaagaataatgcatatgtgattgttcttaaagtcaatgtattaaataaggtatttttccttttccctcttactggatttttcaattttcaaaccatatggcctaggtaactttaattgaaataatatagatttagttgaatactattcaggaagtaataaattttaatatatcacattgaaattatgcagtggtgatgaattttggtgtttcccccctctttctggttttacatcatgaggatcagttagctgctgacaagaaaagtcatcttgtgtcttttgtaaattgaattttttttttaaatctattaggaactggaaaacagcaagtatggttgattctcattattcaaggtagttacgttctataaagtcactgcgaacactgaattagcaaatatagaacctaggggaaatacaaggctagatttctgcaagccactggtcacattttcatcaagcagtcaacatgtaaatttctgttgtaaagacaccttatttaatataatcgattcattaacattgaagtcatgaccaacaacactgtaactcatgcctgaatgaagcttatctgacacataagcttcataaggcacacaacagcctttttacccttaggaacagctttttgcccttagcactatgcttgggggccattttaaacagtgaaatcaaaaaaagaacagaaatgcaaaaaccatggcattagcgtaaaaaggacacgtttatagtatgaaagctggaacatggccttgttcaacctcagctcagaatatgtgtacagcaagttttttgctgtaccacaaaattttaggttaggcaaattcacaaatacggaatccatgaataacgaggatcaactgtacttaactatattttaaagctgtgacatttatctacctggtttatggaatagaatttattgctgaatcatgctccagtatttgagtgatgttttaaatatcctatgtctgaaaataattcctcctaattgtgtggtaatttgcttttactgtttccacagtatttcaggtctttgctcattcactcagtaatactgagcacttaccatgtaccagaattttactaggcacaaccatgaataaaaatacaattctcttgcaccattaaaaaaaaag

SEQ ID NO: 308256 - DNA, 4735 bp, Homo sapiens
cctcattcacacgagaaaacaccctcatgttcatacacctatcccccattctcctcctatccctcaaccccgacatcattaccgggttttcctcttaaaaaaataaaaaaaaaaaaaaagcaagaaaaaagaaaaactttaagattgctgtgaaaataataggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttatggctttttactgttagactaatcaaaaataactttaaaaggaacaaagaaactccaacatttcacattatgcatagttatgtagccatttcacagtttctttaagatgtgtaaactcattgtccttgatagtttttatttttcattataaaattataccaggagatttcttttaagattctgagttagcagagttcaaaactattttgtggaaacaagccaactagtaacaatgcagcaacacttctggtttagctaaattatttttccaatgtaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgttcattttgatttattttaaatctttacattcagaaatgagatactgtattatcagaccaggaggcattgctgtgaaagataatttcctattctaaaatatcaaatttaaaataaagataatgaaagaaaacataagagaactattggactctaattgctttgaactagttttgcagtttgactttacgtcttatacatcttagttacaagtctttggaaactcttgtttacttatgagcataatcattccttggagttatactaactaataatgaatattaaatgatttttcttcagtcacagtgagagcatcttgctttgtggttgaaataggtagtgtatgtcagtctttgctttaggctgtttctcatctaagtgtttgaattaaagatgttaaatttttctaattgtgaaaaatatgttttctgtatcgacacattttattaaacttggcttgattgcttctttatagtagtccctgtaagtggacataaatgtggctatttgatgttaatgcaactatgtcaaggctgcaatcactttaatagtttctttttagcaaataaatgttcattgatgaagtgcctgggtattttcccgtcccatttgcagagctctactacttcatttccacagtaagcatatatataatgatcacttctgagtttatcaccagtaacattgatacctattttggggtataaacatggtgtttttcagaaataaaaattatttcattaacctttactattactgtgataatacccaggcactcaatattcatcctgaaattttttataatatatgtaatttgtctagtcttaaagacatttggagcatggccaacaggaaggtcagcttcttactgatgtgtgtggattcttacagaatgttagtacaaatttttataaatatttggtgatccctggggggaaatatcattcttactatggttagaaagtgaattagaaatttcagctcagtttctattttactattcaagttgtgtactttaaacaaatataaaaatcaaaaggctgcctctattacaatcctcagtggaatagatggctatctttcttggctaacattaaatattcttgtaccagagcatggaaaatcgtttataattgttaatagaatggcgatttttttttaagaacttcagatttgctatgctgctgtaagtagaaagcatgaagctttttgatcatgtagggcttattgtagagggtatcaattggcctaactaagcaggattgaatttaccagaggctaagttcagatagtaagaataatgcatatgtgattgttcttaaagtcaatgtattaaataaggtatttttccttttccctcttactggatttttcaattttcaaaccatatggcctaggtaactttaattgaaataatatagatttagttgaatactattcaggaagtaataaattttaatatatcacattgaaattatgcagtggtgatgaattttggtgtttcccccctctttctggttttacatcatgaggatcagttagctgctgacaagaaaagtcatcttgtgtcttttgtaaattgaattttttttttaaatctattaggaactggaaaacagcaagtatggttgattctcattattcaaggtagttacgttctataaagtcactgcgaacactgaattagcaaatatagaacctaggggaaatacaaggctagatttctgcaagccactggtcacattttcatcaagcagtcaacatgtaaatttctgttgtaaagacaccttatttaatataatcgattcattaacattgaagtcatgaccaacaacactgtaactcatgcctgaatgaagcttatctgacacataagcttcataaggcacacaacagcctttttacccttaggaacagctttttgcccttagcactatgcttgggggccattttaaacagtgaaatcaaaaaaagaacagaaatgcaaaaaccatggcattagcgtaaaaaggacacgtttatagtatgaaagctggaacatggccttgttcaacctcagctcagaatatgtgtacagcaagttttttgctgtaccacaaaattttaggttaggcaaattcacaaatacggaatccatgaataacgaggatcaactgtacttaactatattttaaagctgtgacatttatctacctggtttatggaatagaatttattgctgaatcatgctccagtatttgagtgatgttttaaatatcctatgtctgaaaataattcctcctaattgtgtggtaatttgcttttactgtttccacagtatttcaggtctttgctcattcactcagtaatactgagcacttaccatgtaccagaattttactaggcacaaccatgaataaaaatacaattctcttgcaccattaaaaaaaaag

SEQ ID NO: 308257 - DNA, 5292 bp, Homo sapiens
tttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcgaagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggtcttgatatttttgcttttcagtctctatctatatggggagtgtaatgccatacctgtttttcccaaaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttatggctttttactgttagactaatcaaaaataactttaaaaggaacaaagaaactccaacatttcacattatgcatagttatgtagccatttcacagtttctttaagatgtgtaaactcattgtccttgatagtttttatttttcattataaaattataccaggagatttcttttaagattctgagttagcagagttcaaaactattttgtggaaacaagccaactagtaacaatgcagcaacacttctggtttagctaaattatttttccaatgtaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgttcattttgatttattttaaatctttacattcagaaatgagatactgtattatcagaccaggaggcattgctgtgaaagataatttcctattctaaaatatcaaatttaaaataaagataatgaaagaaaacataagagaactattggactctaattgctttgaactagttttgcagtttgactttacgtcttatacatcttagttacaagtctttggaaactcttgtttacttatgagcataatcattccttggagttatactaactaataatgaatattaaatgatttttcttcagtcacagtgagagcatcttgctttgtggttgaaataggtagtgtatgtcagtctttgctttaggctgtttctcatctaagtgtttgaattaaagatgttaaatttttctaattgtgaaaaatatgttttctgtatcgacacattttattaaacttggcttgattgcttctttatagtagtccctgtaagtggacataaatgtggctatttgatgttaatgcaactatgtcaaggctgcaatcactttaatagtttctttttagcaaataaatgttcattgatgaagtgcctgggtattttcccgtcccatttgcagagctctactacttcatttccacagtaagcatatatataatgatcacttctgagtttatcaccagtaacattgatacctattttggggtataaacatggtgtttttcagaaataaaaattatttcattaacctttactattactgtgataatacccaggcactcaatattcatcctgaaattttttataatatatgtaatttgtctagtcttaaagacatttggagcatggccaacaggaaggtcagcttcttactgatgtgtgtggattcttacagaatgttagtacaaatttttataaatatttggtgatccctggggggaaatatcattcttactatggttagaaagtgaattagaaatttcagctcagtttctattttactattcaagttgtgtactttaaacaaatataaaaatcaaaaggctgcctctattacaatcctcagtggaatagatggctatctttcttggctaacattaaatattcttgtaccagagcatggaaaatcgtttataattgttaatagaatggcgatttttttttaagaacttcagatttgctatgctgctgtaagtagaaagcatgaagctttttgatcatgtagggcttattgtagagggtatcaattggcctaactaagcaggattgaatttaccagaggctaagttcagatagtaagaataatgcatatgtgattgttcttaaagtcaatgtattaaataaggtatttttccttttccctcttactggatttttcaattttcaaaccatatggcctaggtaactttaattgaaataatatagatttagttgaatactattcaggaagtaataaattttaatatatcacattgaaattatgcagtggtgatgaattttggtgtttcccccctctttctggttttacatcatgaggatcagttagctgctgacaagaaaagtcatcttgtgtcttttgtaaattgaattttttttttaaatctattaggaactggaaaacagcaagtatggttgattctcattattcaaggtagttacgttctataaagtcactgcgaacactgaattagcaaatatagaacctaggggaaatacaaggctagatttctgcaagccactggtcacattttcatcaagcagtcaacatgtaaatttctgttgtaaagacaccttatttaatataatcgattcattaacattgaagtcatgaccaacaacactgtaactcatgcctgaatgaagcttatctgacacataagcttcataaggcacacaacagcctttttacccttaggaacagctttttgcccttagcactatgcttgggggccattttaaacagtgaaatcaaaaaaagaacagaaatgcaaaaaccatggcattagcgtaaaaaggacacgtttatagtatgaaagctggaacatggccttgttcaacctcagctcagaatatgtgtacagcaagttttttgctgtaccacaaaattttaggttaggcaaattcacaaatacggaatccatgaataacgaggatcaactgtacttaactatattttaaagctgtgacatttatctacctggtttatggaatagaatttattgctgaatcatgctccagtatttgagtgatgttttaaatatcctatgtctgaaaataattcctcctaattgtgtggtaatttgcttttactgtttccacagtatttcaggtctttgctcattcactcagtaatactgagcacttaccatgtaccagaattttactaggcacaaccatgaataaaaatacaattctcttgcaccattaaaaaaaaag

SEQ ID NO: 308258 - DNA, 3980 bp, Homo sapiens
tttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcgaagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgttcattttgatttattttaaatctttacattcagaaatgagatactgtattatcagaccaggaggcattgctgtgaaagataatttcctattctaaaatatcaaatttaaaataaagataatgaaagaaaacataagagaactattggactctaattgctttgaactagttttgcagtttgactttacgtcttatacatcttagttacaagtctttggaaactcttgtttacttatgagcataatcattccttggagttatactaactaataatgaatattaaatgatttttcttcagtcacagtgagagcatcttgctttgtggttgaaataggtagtgtatgtcagtctttgctttaggctgtttctcatctaagtgtttgaattaaagatgttaaatttttctaattgtgaaaaatatgttttctgtatcgacacattttattaaacttggcttgattgcttctttatagtagtccctgtaagtggacataaatgtggctatttgatgttaatgcaactatgtcaaggctgcaatcactttaatagtttctttttagcaaataaatgttcattgatgaagtgcctgggtattttcccgtcccatttgcagagctctactacttcatttccacagtaagcatatatataatgatcacttctgagtttatcaccagtaacattgatacctattttggggtataaacatggtgtttttcagaaataaaaattatttcattaacctttactattactgtgataatacccaggcactcaatattcatcctgaaattttttataatatatgtaatttgtctagtcttaaagacatttggagcatggccaacaggaaggtcagcttcttactgatgtgtgtggattcttacagaatgttagtacaaatttttataaatatttggtgatccctggggggaaatatcattcttactatggttagaaagtgaattagaaatttcagctcagtttctattttactattcaagttgtgtactttaaacaaatataaaaatcaaaaggctgcctctattacaatcctcagtggaatagatggctatctttcttggctaacattaaatattcttgtaccagagcatggaaaatcgtttataattgttaatagaatggcgatttttttttaagaacttcagatttgctatgctgctgtaagtagaaagcatgaagctttttgatcatgtagggcttattgtagagggtatcaattggcctaactaagcaggattgaatttaccagaggctaagttcagatagtaagaataatgcatatgtgattgttcttaaagtcaatgtattaaataaggtatttttccttttccctcttactggatttttcaattttcaaaccatatggcctaggtaactttaattgaaataatatagatttagttgaatactattcaggaagtaataaattttaatatatcacattgaaattatgcagtggtgatgaattttggtgtttcccccctctttctggttttacatcatgaggatcagttagctgctgacaagaaaagtcatcttgtgtcttttgtaaattgaattttttttttaaatctattaggaactggaaaacagcaagtatggttgattctcattattcaaggtagttacgttctataaagtcactgcgaacactgaattagcaaatatagaacctaggggaaatacaaggctagatttctgcaagccactggtcacattttcatcaagcagtcaacatgtaaatttctgttgtaaagacaccttatttaatataatcgattcattaacattgaagtcatgaccaacaacactgtaactcatgcctgaatgaagcttatctgacacataagcttcataaggcacacaacagcctttttacccttaggaacagctttttgcccttagcactatgcttgggggccattttaaacagtgaaatcaaaaaaagaacagaaatgcaaaaaccatggcattagcgtaaaaaggacacgtttatagtatgaaagctggaacatggccttgttcaacctcagctcagaatatgtgtacagcaagttttttgctgtaccacaaaattttaggttaggcaaattcacaaatacggaatccatgaataacgaggatcaactgtacttaactatattttaaagctgtgacatttatctacctggtttatggaatagaatttattgctgaatcatgctccagtatttgagtgatgttttaaatatcctatgtctgaaaataattcctcctaattgtgtggtaatttgcttttactgtttccacagtatttcaggtctttgctcattcactcagtaatactgagcacttaccatgtaccagaattttactaggcacaaccatgaataaaaatacaattctcttgcaccattaaaaaaaaag

SEQ ID NO: 308259 - DNA, 4495 bp, Homo sapiens
ggcaacttggcaagagcccatctctacacacctggctaatttttgtatttttagtagaggcagggtttcaccatgttggccaggcttgtcttgaacttctgacctcaagtgatctggccgccttggccttcaaagtgctgggattataggcgtgagccaccaagcccagtcaaacaaatttttaagtgtatgtaagaacatacaaatttacttaagtgctttatagaatttatagttatcctataatcattttctagcgccagaagaaccactactactgaaggaaagatctttggaatttatttaccttagaaattacttctcgtatgttaagaggttgatgactgctttaagggacctaaaatatagaattaagcattactttctaatgtgacattagaacttttaagcaccgaggtttcttgattcttctaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttatggctttttactgttagactaatcaaaaataactttaaaaggaacaaagaaactccaacatttcacattatgcatagttatgtagccatttcacagtttctttaagatgtgtaaactcattgtccttgatagtttttatttttcattataaaattataccaggagatttcttttaagattctgagttagcagagttcaaaactattttgtggaaacaagccaactagtaacaatgcagcaacacttctggtttagctaaattatttttccaatgtaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgttcattttgatttattttaaatctttacattcagaaatgagatactgtattatcagaccaggaggcattgctgtgaaagataatttcctattctaaaatatcaaatttaaaataaagataatgaaagaaaacataagagaactattggactctaattgctttgaactagttttgcagtttgactttacgtcttatacatcttagttacaagtctttggaaactcttgtttacttatgagcataatcattccttggagttatactaactaataatgaatattaaatgatttttcttcagtcacagtgagagcatcttgctttgtggttgaaataggtagtgtatgtcagtctttgctttaggctgtttctcatctaagtgtttgaattaaagatgttaaatttttctaattgtgaaaaatatgttttctgtatcgacacattttattaaacttggcttgattgcttctttatagtagtccctgtaagtggacataaatgtggctatttgatgttaatgcaactatgtcaaggctgcaatcactttaatagtttctttttagcaaataaatgttcattgatgaagtgcctgggtattttcccgtcccatttgcagagctctactacttcatttccacagtaagcatatatataatgatcacttctgagtttatcaccagtaacattgatacctattttggggtataaacatggtgtttttcagaaataaaaattatttcattaacctttactattactgtgataatacccaggcactcaatattcatcctgaaattttttataatatatgtaatttgtctagtcttaaagacatttggagcatggccaacaggaaggtcagcttcttactgatgtgtgtggattcttacagaatgttagtacaaatttttataaatatttggtgatccctggggggaaatatcattcttactatggttagaaagtgaattagaaatttcagctcagtttctattttactattcaagttgtgtactttaaacaaatataaaaatcaaaaggctgcctctattacaatcctcagtggaatagatggctatctttcttggctaacattaaatattcttgtaccagagcatggaaaatcgtttataattgttaatagaatggcgatttttttttaagaacttcagatttgctatgctgctgtaagtagaaagcatgaagctttttgatcatgtagggcttattgtagagggtatcaattggcctaactaagcaggattgaatttaccagaggctaagttcagatagtaagaataatgcatatgtgattgttcttaaagtcaatgtattaaataaggtatttttccttttccctcttactggatttttcaattttcaaaccatatggcctaggtaactttaattgaaataatatagatttagttgaatactattcaggaagtaataaattttaatatatcacattgaaattatgcagtggtgatgaattttggtgtttcccccctctttctggttttacatcatgaggatcagttagctgctgacaagaaaagtcatcttgtgtcttttgtaaattgaattttttttttaaatctattaggaactggaaaacagcaagtatggttgattctcattattcaaggtagttacgttctataaagtcactgcgaacactgaattagcaaatatagaacctaggggaaatacaaggctagatttctgcaagccactggtcacattttcatcaagcagtcaacatgtaaatttctgttgtaaagacaccttatttaatataatcgattcattaacattgaagtcatgaccaacaacactgtaactcatgcctgaatgaagcttatctgacacataagcttcataaggcacacaacagcctttttacccttaggaacagctttttgcccttagcactatgcttgggggccattttaaacagtgaaatcaaaaaaagaacagaaatgcaaaaaccatggcattagcgtaaaaaggacacgtttatagtatgaaagctggaacatggccttgttcaacctcagctcagaatatgtgtacagcaagttttttgctgtaccacaaaattttaggttaggcaaattcacaaatacggaatccatgaataacgaggatcaactgtacttaactatattttaaagctgtgacatttatctacctggtttatggaatagaatttattgctgaatcatgctccagtatttgagtgatgttttaaatatcctatgtctgaaaataattcctcctaattgtgtggtaatttgcttttactgtttccacagtatttcaggtctttgctcattcactcagtaatactgagcacttaccatgtaccagaattttactaggcacaaccatgaataaaaatacaattctcttgcaccattaaaaaaaaag

SEQ ID NO: 308260 - DNA, 4348 bp, Homo sapiens
  misc_feature (88)..(88): n is a, c, g, or t
tcatcagctcgcccgtatgctactgtgtggatcccttcttcttcctaactttcagttcttatctgcaaagtggaaggtcagaccagantatgctctggtactccacagtgctcacctgtatcactgcagggctttctgcactgaaagtggaagcagaaggctaatgggtcacattgtgtaaaggtctctggtgctcaaagtttctaggcaaagaagtgaaaatttggaattctgtcttaactgcgcttttatcccagactggttcatcattacattagggacaaaaaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttatggctttttactgttagactaatcaaaaataactttaaaaggaacaaagaaactccaacatttcacattatgcatagttatgtagccatttcacagtttctttaagatgtgtaaactcattgtccttgatagtttttatttttcattataaaattataccaggagatttcttttaagattctgagttagcagagttcaaaactattttgtggaaacaagccaactagtaacaatgcagcaacacttctggtttagctaaattatttttccaatgtaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgttcattttgatttattttaaatctttacattcagaaatgagatactgtattatcagaccaggaggcattgctgtgaaagataatttcctattctaaaatatcaaatttaaaataaagataatgaaagaaaacataagagaactattggactctaattgctttgaactagttttgcagtttgactttacgtcttatacatcttagttacaagtctttggaaactcttgtttacttatgagcataatcattccttggagttatactaactaataatgaatattaaatgatttttcttcagtcacagtgagagcatcttgctttgtggttgaaataggtagtgtatgtcagtctttgctttaggctgtttctcatctaagtgtttgaattaaagatgttaaatttttctaattgtgaaaaatatgttttctgtatcgacacattttattaaacttggcttgattgcttctttatagtagtccctgtaagtggacataaatgtggctatttgatgttaatgcaactatgtcaaggctgcaatcactttaatagtttctttttagcaaataaatgttcattgatgaagtgcctgggtattttcccgtcccatttgcagagctctactacttcatttccacagtaagcatatatataatgatcacttctgagtttatcaccagtaacattgatacctattttggggtataaacatggtgtttttcagaaataaaaattatttcattaacctttactattactgtgataatacccaggcactcaatattcatcctgaaattttttataatatatgtaatttgtctagtcttaaagacatttggagcatggccaacaggaaggtcagcttcttactgatgtgtgtggattcttacagaatgttagtacaaatttttataaatatttggtgatccctggggggaaatatcattcttactatggttagaaagtgaattagaaatttcagctcagtttctattttactattcaagttgtgtactttaaacaaatataaaaatcaaaaggctgcctctattacaatcctcagtggaatagatggctatctttcttggctaacattaaatattcttgtaccagagcatggaaaatcgtttataattgttaatagaatggcgatttttttttaagaacttcagatttgctatgctgctgtaagtagaaagcatgaagctttttgatcatgtagggcttattgtagagggtatcaattggcctaactaagcaggattgaatttaccagaggctaagttcagatagtaagaataatgcatatgtgattgttcttaaagtcaatgtattaaataaggtatttttccttttccctcttactggatttttcaattttcaaaccatatggcctaggtaactttaattgaaataatatagatttagttgaatactattcaggaagtaataaattttaatatatcacattgaaattatgcagtggtgatgaattttggtgtttcccccctctttctggttttacatcatgaggatcagttagctgctgacaagaaaagtcatcttgtgtcttttgtaaattgaattttttttttaaatctattaggaactggaaaacagcaagtatggttgattctcattattcaaggtagttacgttctataaagtcactgcgaacactgaattagcaaatatagaacctaggggaaatacaaggctagatttctgcaagccactggtcacattttcatcaagcagtcaacatgtaaatttctgttgtaaagacaccttatttaatataatcgattcattaacattgaagtcatgaccaacaacactgtaactcatgcctgaatgaagcttatctgacacataagcttcataaggcacacaacagcctttttacccttaggaacagctttttgcccttagcactatgcttgggggccattttaaacagtgaaatcaaaaaaagaacagaaatgcaaaaaccatggcattagcgtaaaaaggacacgtttatagtatgaaagctggaacatggccttgttcaacctcagctcagaatatgtgtacagcaagttttttgctgtaccacaaaattttaggttaggcaaattcacaaatacggaatccatgaataacgaggatcaactgtacttaactatattttaaagctgtgacatttatctacctggtttatggaatagaatttattgctgaatcatgctccagtatttgagtgatgttttaaatatcctatgtctgaaaataattcctcctaattgtgtggtaatttgcttttactgtttccacagtatttcaggtctttgctcattcactcagtaatactgagcacttaccatgtaccagaattttactaggcacaaccatgaataaaaatacaattctcttgcaccattaaaaaaaaag

SEQ ID NO: 308261 - DNA, 4239 bp, Homo sapiens
aaaatctaacgttgagtaaatgtgatagtgatgagaaaggaattttgtgtactgtaaccttgcagtagagatgcagctgtccttcgtgtgtggaaacacacctctcctttacatagttgggaacctcattagaaatgacttgcttttctaaatctcaggtttttctggatggaaatgaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttatggctttttactgttagactaatcaaaaataactttaaaaggaacaaagaaactccaacatttcacattatgcatagttatgtagccatttcacagtttctttaagatgtgtaaactcattgtccttgatagtttttatttttcattataaaattataccaggagatttcttttaagattctgagttagcagagttcaaaactattttgtggaaacaagccaactagtaacaatgcagcaacacttctggtttagctaaattatttttccaatgtaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgttcattttgatttattttaaatctttacattcagaaatgagatactgtattatcagaccaggaggcattgctgtgaaagataatttcctattctaaaatatcaaatttaaaataaagataatgaaagaaaacataagagaactattggactctaattgctttgaactagttttgcagtttgactttacgtcttatacatcttagttacaagtctttggaaactcttgtttacttatgagcataatcattccttggagttatactaactaataatgaatattaaatgatttttcttcagtcacagtgagagcatcttgctttgtggttgaaataggtagtgtatgtcagtctttgctttaggctgtttctcatctaagtgtttgaattaaagatgttaaatttttctaattgtgaaaaatatgttttctgtatcgacacattttattaaacttggcttgattgcttctttatagtagtccctgtaagtggacataaatgtggctatttgatgttaatgcaactatgtcaaggctgcaatcactttaatagtttctttttagcaaataaatgttcattgatgaagtgcctgggtattttcccgtcccatttgcagagctctactacttcatttccacagtaagcatatatataatgatcacttctgagtttatcaccagtaacattgatacctattttggggtataaacatggtgtttttcagaaataaaaattatttcattaacctttactattactgtgataatacccaggcactcaatattcatcctgaaattttttataatatatgtaatttgtctagtcttaaagacatttggagcatggccaacaggaaggtcagcttcttactgatgtgtgtggattcttacagaatgttagtacaaatttttataaatatttggtgatccctggggggaaatatcattcttactatggttagaaagtgaattagaaatttcagctcagtttctattttactattcaagttgtgtactttaaacaaatataaaaatcaaaaggctgcctctattacaatcctcagtggaatagatggctatctttcttggctaacattaaatattcttgtaccagagcatggaaaatcgtttataattgttaatagaatggcgatttttttttaagaacttcagatttgctatgctgctgtaagtagaaagcatgaagctttttgatcatgtagggcttattgtagagggtatcaattggcctaactaagcaggattgaatttaccagaggctaagttcagatagtaagaataatgcatatgtgattgttcttaaagtcaatgtattaaataaggtatttttccttttccctcttactggatttttcaattttcaaaccatatggcctaggtaactttaattgaaataatatagatttagttgaatactattcaggaagtaataaattttaatatatcacattgaaattatgcagtggtgatgaattttggtgtttcccccctctttctggttttacatcatgaggatcagttagctgctgacaagaaaagtcatcttgtgtcttttgtaaattgaattttttttttaaatctattaggaactggaaaacagcaagtatggttgattctcattattcaaggtagttacgttctataaagtcactgcgaacactgaattagcaaatatagaacctaggggaaatacaaggctagatttctgcaagccactggtcacattttcatcaagcagtcaacatgtaaatttctgttgtaaagacaccttatttaatataatcgattcattaacattgaagtcatgaccaacaacactgtaactcatgcctgaatgaagcttatctgacacataagcttcataaggcacacaacagcctttttacccttaggaacagctttttgcccttagcactatgcttgggggccattttaaacagtgaaatcaaaaaaagaacagaaatgcaaaaaccatggcattagcgtaaaaaggacacgtttatagtatgaaagctggaacatggccttgttcaacctcagctcagaatatgtgtacagcaagttttttgctgtaccacaaaattttaggttaggcaaattcacaaatacggaatccatgaataacgaggatcaactgtacttaactatattttaaagctgtgacatttatctacctggtttatggaatagaatttattgctgaatcatgctccagtatttgagtgatgttttaaatatcctatgtctgaaaataattcctcctaattgtgtggtaatttgcttttactgtttccacagtatttcaggtctttgctcattcactcagtaatactgagcacttaccatgtaccagaattttactaggcacaaccatgaataaaaatacaattctcttgcaccattaaaaaaaaag

SEQ ID NO: 308262 - DNA, 4161 bp, Homo sapiens
cactttactcaacaggtcagattagataagaacctctgagaatctcctagttggcacacagtactaaagactggaatagcttccagagatgatttatcttaaaataaacgttgttcataagaaactagaatttctacaacagttttgagattggtcatcttttgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttatggctttttactgttagactaatcaaaaataactttaaaaggaacaaagaaactccaacatttcacattatgcatagttatgtagccatttcacagtttctttaagatgtgtaaactcattgtccttgatagtttttatttttcattataaaattataccaggagatttcttttaagattctgagttagcagagttcaaaactattttgtggaaacaagccaactagtaacaatgcagcaacacttctggtttagctaaattatttttccaatgtaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgttcattttgatttattttaaatctttacattcagaaatgagatactgtattatcagaccaggaggcattgctgtgaaagataatttcctattctaaaatatcaaatttaaaataaagataatgaaagaaaacataagagaactattggactctaattgctttgaactagttttgcagtttgactttacgtcttatacatcttagttacaagtctttggaaactcttgtttacttatgagcataatcattccttggagttatactaactaataatgaatattaaatgatttttcttcagtcacagtgagagcatcttgctttgtggttgaaataggtagtgtatgtcagtctttgctttaggctgtttctcatctaagtgtttgaattaaagatgttaaatttttctaattgtgaaaaatatgttttctgtatcgacacattttattaaacttggcttgattgcttctttatagtagtccctgtaagtggacataaatgtggctatttgatgttaatgcaactatgtcaaggctgcaatcactttaatagtttctttttagcaaataaatgttcattgatgaagtgcctgggtattttcccgtcccatttgcagagctctactacttcatttccacagtaagcatatatataatgatcacttctgagtttatcaccagtaacattgatacctattttggggtataaacatggtgtttttcagaaataaaaattatttcattaacctttactattactgtgataatacccaggcactcaatattcatcctgaaattttttataatatatgtaatttgtctagtcttaaagacatttggagcatggccaacaggaaggtcagcttcttactgatgtgtgtggattcttacagaatgttagtacaaatttttataaatatttggtgatccctggggggaaatatcattcttactatggttagaaagtgaattagaaatttcagctcagtttctattttactattcaagttgtgtactttaaacaaatataaaaatcaaaaggctgcctctattacaatcctcagtggaatagatggctatctttcttggctaacattaaatattcttgtaccagagcatggaaaatcgtttataattgttaatagaatggcgatttttttttaagaacttcagatttgctatgctgctgtaagtagaaagcatgaagctttttgatcatgtagggcttattgtagagggtatcaattggcctaactaagcaggattgaatttaccagaggctaagttcagatagtaagaataatgcatatgtgattgttcttaaagtcaatgtattaaataaggtatttttccttttccctcttactggatttttcaattttcaaaccatatggcctaggtaactttaattgaaataatatagatttagttgaatactattcaggaagtaataaattttaatatatcacattgaaattatgcagtggtgatgaattttggtgtttcccccctctttctggttttacatcatgaggatcagttagctgctgacaagaaaagtcatcttgtgtcttttgtaaattgaattttttttttaaatctattaggaactggaaaacagcaagtatggttgattctcattattcaaggtagttacgttctataaagtcactgcgaacactgaattagcaaatatagaacctaggggaaatacaaggctagatttctgcaagccactggtcacattttcatcaagcagtcaacatgtaaatttctgttgtaaagacaccttatttaatataatcgattcattaacattgaagtcatgaccaacaacactgtaactcatgcctgaatgaagcttatctgacacataagcttcataaggcacacaacagcctttttacccttaggaacagctttttgcccttagcactatgcttgggggccattttaaacagtgaaatcaaaaaaagaacagaaatgcaaaaaccatggcattagcgtaaaaaggacacgtttatagtatgaaagctggaacatggccttgttcaacctcagctcagaatatgtgtacagcaagttttttgctgtaccacaaaattttaggttaggcaaattcacaaatacggaatccatgaataacgaggatcaactgtacttaactatattttaaagctgtgacatttatctacctggtttatggaatagaatttattgctgaatcatgctccagtatttgagtgatgttttaaatatcctatgtctgaaaataattcctcctaattgtgtggtaatttgcttttactgtttccacagtatttcaggtctttgctcattcactcagtaatactgagcacttaccatgtaccagaattttactaggcacaaccatgaataaaaatacaattctcttgcaccattaaaaaaaaag

SEQ ID NO: 308263 - DNA, 4017 bp, Homo sapiens
tcccacagccggtggtcccgcatacgcccaggtaggcaaacccggaccacctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttatggctttttactgttagactaatcaaaaataactttaaaaggaacaaagaaactccaacatttcacattatgcatagttatgtagccatttcacagtttctttaagatgtgtaaactcattgtccttgatagtttttatttttcattataaaattataccaggagatttcttttaagattctgagttagcagagttcaaaactattttgtggaaacaagccaactagtaacaatgcagcaacacttctggtttagctaaattatttttccaatgtaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgttcattttgatttattttaaatctttacattcagaaatgagatactgtattatcagaccaggaggcattgctgtgaaagataatttcctattctaaaatatcaaatttaaaataaagataatgaaagaaaacataagagaactattggactctaattgctttgaactagttttgcagtttgactttacgtcttatacatcttagttacaagtctttggaaactcttgtttacttatgagcataatcattccttggagttatactaactaataatgaatattaaatgatttttcttcagtcacagtgagagcatcttgctttgtggttgaaataggtagtgtatgtcagtctttgctttaggctgtttctcatctaagtgtttgaattaaagatgttaaatttttctaattgtgaaaaatatgttttctgtatcgacacattttattaaacttggcttgattgcttctttatagtagtccctgtaagtggacataaatgtggctatttgatgttaatgcaactatgtcaaggctgcaatcactttaatagtttctttttagcaaataaatgttcattgatgaagtgcctgggtattttcccgtcccatttgcagagctctactacttcatttccacagtaagcatatatataatgatcacttctgagtttatcaccagtaacattgatacctattttggggtataaacatggtgtttttcagaaataaaaattatttcattaacctttactattactgtgataatacccaggcactcaatattcatcctgaaattttttataatatatgtaatttgtctagtcttaaagacatttggagcatggccaacaggaaggtcagcttcttactgatgtgtgtggattcttacagaatgttagtacaaatttttataaatatttggtgatccctggggggaaatatcattcttactatggttagaaagtgaattagaaatttcagctcagtttctattttactattcaagttgtgtactttaaacaaatataaaaatcaaaaggctgcctctattacaatcctcagtggaatagatggctatctttcttggctaacattaaatattcttgtaccagagcatggaaaatcgtttataattgttaatagaatggcgatttttttttaagaacttcagatttgctatgctgctgtaagtagaaagcatgaagctttttgatcatgtagggcttattgtagagggtatcaattggcctaactaagcaggattgaatttaccagaggctaagttcagatagtaagaataatgcatatgtgattgttcttaaagtcaatgtattaaataaggtatttttccttttccctcttactggatttttcaattttcaaaccatatggcctaggtaactttaattgaaataatatagatttagttgaatactattcaggaagtaataaattttaatatatcacattgaaattatgcagtggtgatgaattttggtgtttcccccctctttctggttttacatcatgaggatcagttagctgctgacaagaaaagtcatcttgtgtcttttgtaaattgaattttttttttaaatctattaggaactggaaaacagcaagtatggttgattctcattattcaaggtagttacgttctataaagtcactgcgaacactgaattagcaaatatagaacctaggggaaatacaaggctagatttctgcaagccactggtcacattttcatcaagcagtcaacatgtaaatttctgttgtaaagacaccttatttaatataatcgattcattaacattgaagtcatgaccaacaacactgtaactcatgcctgaatgaagcttatctgacacataagcttcataaggcacacaacagcctttttacccttaggaacagctttttgcccttagcactatgcttgggggccattttaaacagtgaaatcaaaaaaagaacagaaatgcaaaaaccatggcattagcgtaaaaaggacacgtttatagtatgaaagctggaacatggccttgttcaacctcagctcagaatatgtgtacagcaagttttttgctgtaccacaaaattttaggttaggcaaattcacaaatacggaatccatgaataacgaggatcaactgtacttaactatattttaaagctgtgacatttatctacctggtttatggaatagaatttattgctgaatcatgctccagtatttgagtgatgttttaaatatcctatgtctgaaaataattcctcctaattgtgtggtaatttgcttttactgtttccacagtatttcaggtctttgctcattcactcagtaatactgagcacttaccatgtaccagaattttactaggcacaaccatgaataaaaatacaattctcttgcaccattaaaaaaaaag

SEQ ID NO: 308264 - DNA, 3408 bp, Homo sapiens
  misc_feature (28)..(28): n is a, c, g, or t
atgtgaaagtggctacataactatgcanaatgtgaaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttatggctttttactgttagactaatcaaaaataactttaaaaggaacaaagaaactccaacatttcacattatgcatagttatgtagccatttcacagtttctttaagatgtgtaaactcattgtccttgatagtttttatttttcattataaaattataccaggagatttcttttaagattctgagttagcagagttcaaaactattttgtggaaacaagccaactagtaacaatgcagcaacacttctggtttagctaaattatttttccaatgtaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgttcattttgatttattttaaatctttacattcagaaatgagatactgtattatcagaccaggaggcattgctgtgaaagataatttcctattctaaaatatcaaatttaaaataaagataatgaaagaaaacataagagaactattggactctaattgctttgaactagttttgcagtttgactttacgtcttatacatcttagttacaagtctttggaaactcttgtttacttatgagcataatcattccttggagttatactaactaataatgaatattaaatgatttttcttcagtcacagtgagagcatcttgctttgtggttgaaataggtagtgtatgtcagtctttgctttaggctgtttctcatctaagtgtttgaattaaagatgttaaatttttctaattgtgaaaaatatgttttctgtatcgacacattttattaaacttggcttgattgcttctttatagtagtccctgtaagtggacataaatgtggctatttgatgttaatgcaactatgtcaaggctgcaatcactttaatagtttctttttagcaaataaatgttcattgatgaagtgcctgggtattttcccgtcccatttgcagagctctactacttcatttccacagtaagcatatatataatgatcacttctgagtttatcaccagtaacattgatacctattttggggtataaacatggtgtttttcagaaataaaaattatttcattaacctttactattactgtgataatacccaggcactcaatattcatcctgaaattttttataatatatgtaatttgtctagtcttaaagacatttggagcatggccaacaggaaggtcagcttcttactgatgtgtgtggattcttacagaatgttagtacaaatttttataaatatttggtgatccctggggggaaatatcattcttactatggttagaaagtgaattagaaatttcagctcagtttctattttactattcaagttgtgtactttaaacaaatataaaaatcaaaaggctgcctctattacaatcctcagtggaatagatggctatctttcttggctaacattaaatattcttgtaccagagcatggaaaatcgtttataattgttaatagaatggcgatttttttttaagaacttcagatttgctatgctgctgtaagtagaaagcatgaagctttttgatcatgtagggcttattgtagagggtatcaattggcctaactaagcaggattgaatttaccagaggctaagttcagatagtaagaataatgcatatgtgattgttcttaaagtcaatgtattaaataaggtatttttccttttccctcttactggatttttcaattttcaaaccatatggcctaggtaactttaattgaaataatatagatttagttgaatactattcaggaagtaataaattttaatatatcacattgaaattatgcagtggtgatgaattttggtgtttcccccctctttctggttttacatcatgaggatcagttagctgctgacaagaaaagtcatcttgtgtcttttgtaaattgaattttttttttaaatctattaggaactggaaaacagcaagtatggttgattctcattattcaaggtagttacgttctataaagtcactgcgaacactgaattagcaaatatagaacctaggggaaatacaaggctagatttctgcaagccactggtcacattttcatcaagcagtcaacatgtaaatttctgttgtaaagacaccttatttaatataatcgattcattaacattgaagtcatgaccaacaacactgtaactcatgcctgaatgaagcttatctgacacataagcttcataaggcacacaacagcctttttacccttaggaacagctttttgcccttagcactatgcttgggggccattttaaacagtgaaatcaaaaaaagaacagaaatgcaaaaaccatggcattagcgtaaaaaggacacgtttatagtatgaaagctggaacatggccttgttcaacctcagctcagaatatgtgtacagcaagttttttgctgtaccacaaaattttaggttaggcaaattcacaaatacggaatccatgaataacgaggatcaactgtacttaactatattttaaagctgtgacatttatctacctggtttatggaatagaatttattgctgaatcatgctccagtatttgagtgatgttttaaatatcctatgtctgaaaataattcctcctaattgtgtggtaatttgcttttactgtttccacagtatttcaggtctttgctcattcactcagtaatactgagcacttaccatgtaccagaattttactaggcacaaccatgaataaaaatacaattctcttgcaccattaaaaaaaaag

SEQ ID NO: 308265 - DNA, 2580 bp, Homo sapiens
tttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcgaagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttatggctttttactgttagactaatcaaaaataactttaaaaggaacaaagaaactccaacatttcacattatgcatagttatgtagccatttcacagtttctttaagatgtgtaaactcattgtccttgatagtttttatttttcattataaaattataccaggagatttcttttaagattctgagttagcagagttcaaaactattttgtggaaacaagccaactagtaacaatgcagcaacacttctggtttagctaaattatttttccaatgtaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgtt

SEQ ID NO: 308266 - DNA, 2160 bp, Homo sapiens
tttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcgaagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagcagcccactttaatatcgcctccccctccatccccgactccattcccacccagtaaaggtagggtctcaattcaatttttggaccagttatttcaaaggaatgtaccttttccaacaagttaaaaatttaccattaaatgggcaatttttttgac

SEQ ID NO: 308267 - DNA, 2076 bp, Homo sapiens
tttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcgaagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacactttgacgaccattactccttggataagattgtcattcagaaataccatactgtgaatggccactactgtgaacttcgatcagccctgtctaagcaagagatggctagtgcttcatccagccgaagaggtcgaagtggttctggaaactttggtggtggtcgtggaggtggtttcgctggggctt

SEQ ID NO: 308268 - DNA, 1969 bp, Homo sapiens
tttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcgaagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacaacgggccccacgaagagccccgcaaagagccacgcgacgagccgcccctaagagccacccgaagtgccgcaccaagag

SEQ ID NO: 308269 - DNA, 2329 bp, Homo sapiens
  misc_feature (1935)..(1935): n is a, c, g, or t
  misc_feature (1965)..(1965): n is a, c, g, or t
  misc_feature (1996)..(1996): n is a, c, g, or t
  misc_feature (1998)..(1998): n is a, c, g, or t
  misc_feature (2123)..(2123): n is a, c, g, or t
  misc_feature (2134)..(2134): n is a, c, g, or t
  misc_feature (2156)..(2156): n is a, c, g, or t
  misc_feature (2190)..(2190): n is a, c, g, or t
  misc_feature (2238)..(2238): n is a, c, g, or t
  misc_feature (2247)..(2248): n is a, c, g, or t
  misc_feature (2268)..(2268): n is a, c, g, or t
  misc_feature (2328)..(2328): n is a, c, g, or t
tttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcgaagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatggctgcagtgctctgagccctaggattcatctttcttttcaccgtaggtggcctgactggcattgtattagcaaactcatcactagacatcgtactacacgacacgtactacgttgtagctcacttccactatgtcctatcaataggagctgtatttgccatcataggaggcttcattcactgatttcccctattctcaggctacaccctagaccaaacctacgccanaatccatcactatcatattcatcggcgtanatctaactttcttcccacaacactttctcgncntatcggaatgccccgacgttactcggactaccccgatgcatacaccacatgaaacatcctatcatctgtaggctcattcatttctctaacagcagtaatattaataattttcatgatttgagaanccttcgcttcnaagcgaaaatcctaattagtanaagaaccctccataaacctggaattgactatatngatgcccccccaccctaccacacatttcgaagaacccgttataccatnaaaatcttnnacaaaaaggaaaggaatccnaaccccccccaagcttggttttcaaagcccaaccccccatgggctcccatgaactttttnc

SEQ ID NO: 308270 - DNA, 1704 bp, Homo sapiens
tttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcgaagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggcggcccggttaacccggaccgcctttgtcttccgagttcacctgtgtgaaggcgacagtggtgcaggtcttcctgtggactagacgtcccagtcttgcctttcccttgataatgcagtaagggacccccattttacgacacaggtcaggcaagaagacaaccagctcgatgtgatccacgtcgtgtgcaatcaccaccagctgagctttcttgttctccaccaaagga

SEQ ID NO: 308271 - DNA, 1427 bp, Homo sapiens
tttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcgaagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttggaagttggtgaaccatctaaagaagagaaggctgtggccaagtatcttcgattcaactgtccaacaaagtccaccaatatggat

SEQ ID NO: 308272 - DNA, 1900 bp, Homo sapiens
tttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcgaagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttggtaagtagtgagatgttaatagctataaagtgcaatctaaaatttagaaaacaatatgcagatactgtaaaagaaaatgttcctaaatttaacataaaatagttgtcattttaaaaatactttaaataaagtcagaagataaataatacactaaggaaaatatttgaaacatattaaagatcttttaagagattaacaaactgatagaaaaatggtcaaggtagttaacagataaagaaatacaatgaccaatcatcatgagtgatacttaatcacactcatatacaaattaaagctgtagtgattaagagtcttgcaaaccttaacattaaaggtcttagaaaaaaatcagctctctctaacagttgataggtatgtctattgttttaatttttgtaaagggcagtttgtcagtatctttgaaattttatgtgtctgcagtgacccagcaattctaggctgttcccatacagttgcacaaagtgtgtgcattgacacattatctgtttttttccaaatcccttagactatacttgagtataatctagcaaatatctttcaaattcaaaatgcttataccatttgatctaataaattccactttaaggaatttaccctatgccataatcacagttgcacaaacgtacatgtgcaaggatattatacctagaatagat

SEQ ID NO: 308273 - DNA, 1842 bp, Homo sapiens
tttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcgaagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttggtaagtagtgagatgttaatagctataaagtgcaatctaaaatttagaaaacaatatgcagatactgtaaaagaaaatgttcctaaatttaacataaaatagttgtcattttaaaaatactttaaataaagtcagaagataaataatacactaaggaaaatatttgaaacatattaaagatcttttaagagattaacaaactgatagaaaaatggtcaaggtagttaacagataaagaaatacaatgaccaatcatcatgagtgatacttaatcacactcatatacaaattaaagctgtagtgattaagagtcttgcaaaccttaacattaaaggtcttagaaggcagtttgtcagtatctttgaaattttatgtgtctgcagtgacccagcaattctaggctgttcccatacagttgcacaaagtgtgtgcattgacacattatctgtttttttccaaatcccttagactatacttgagtataatctagcaaatatctttcaaattcaaaatgcttataccatttgatctaataaattccactttaaggaatttaccctatgccataatcacagttgcacaaacgtacatgtgcaaggatattatacctagaatagat

SEQ ID NO: 308274 - DNA, 1346 bp, Homo sapiens
tttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcgaagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggttagagtaagcctataactagaagttcagttttctataggagtttttagaaagatgtttgatgccttcactaataaaaggaaaaattttgagaaatctaattatgctcttaaatgtataaaagctactccatttttaaaatcaataatttctcttatttagatttttaaaagtcagatttgac

SEQ ID NO: 308275 - DNA, 1080 bp, Homo sapiens
tttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcgaagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagagcaggcgcgccggaacctccttttactttttctcctgcgatgcggaacgtacccaccttctttaaaa

SEQ ID NO: 308276 - DNA, 1162 bp, Homo sapiens
tttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcgaagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccagaggctgtggagtaatgtgacagtggcagagagctaaaacttgagccaaactgcctgtttgtaccccacctccaccaattattggctgagtaactttgagcaagttaatttttacctccctgtctgcatcggtaagaaaacatatttacctcaaaaaaaaaaaaagcaagaaaaaagaaaaactttaagattgctgtgaaaataataggaagttggtgaaccatctaaagaagagaaggctgtggccaagtatcttcgattcaactgtccaacaaagtccaccaatatgatgggtcaccgggttgattattttattggtaggattatatcagtaaaatcgtattagtgtacatatgttatgaagttaacctacatttgggatatgtagaagttttaaaagtgctttccaaatgtgattgttctggtgatggacatatggcagttgattattctgttcttttcttttatgattgaaaatgtctataataaaaagataacatgttttctaataaca

SEQ ID NO: 308277 - DNA, 570 bp, Homo sapiens
gaaattagtgaaaccaggaatacatcatgttttgccaaatatattgcacatttttcaatttgatgttgtgcacgtccttttcagagtccaaaaatctcaccttagtatatttaatcattgcttaattgaagataatcattacagtggcacactgaattgcgaagtacttggagaaaaaataacaccaagaaagctgaaaagacattatttggacccatcaaatcatcacttttaatctgttaacatttcttaaactgtttattttctcctttctttattacgtcagctcttgcatttgagacttaacataaagtgaagctgagtcttgattatatgaacccagaaagagtctttatatggataatctcaaacctataatctcttttatacttaaggtacatcattaaaagtgaaaattatattgaatatcactgagttttgacaacttttatataattgactgtaaagtgttttgatttagtggtagagttgactactttttcacgggcatactagttgtaatttctcttgtgttgctaatttatgccttcctttgcttattttattcag

SEQ ID NO: 308278 - DNA, 350 bp, Homo sapiens
agatttgtaaattattattcagcgcatgaatttctcaagtatatgattatactaaattaatattcatatgttgcagggaagttggtgaaccatctaaagaagagaaggctgtggccaagtatcttcgattcaactgtccaacaaagtccaccaatatgatgggtcaccgggttgattattttattggtaggattatatcagtaaaatcgtattagtgtacatatgttatgaagttaacctacatttgggatatgtagaagttttaaaagtgctttccaaatgtgattgttctggtgatggacatatggcagttgattattctgttcttttcttttatgattgaaaatgtc

SEQ ID NO: 308279 - DNA, 1117 bp, Homo sapiens
atccggaccgttagggagcccaatgggcgtcgccgccaggccccgttgcagagcgcgtctagccaataggcagcggcggcgggcgggcgcgggcgacaggcggcgcagctgaggcggagcaggcgctgcggcaggagggaagatggcggacgaggagaagctgccgcccggctgggagaagcgcatgagccgcagctcaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggctacatccagaagatcaagtcgggagaggaggactttgagtctctggcctcacagttcagcgactgcagctcagccaaggccaggggagacctgggtgccttcagcagaggtcagatgcagaagccatttgaagacgcctcgtttgcgctgcggacgggggagatgagcgggcccgtgttcacggattccggcatccacatcatcctccgcactgagtgagggtggggagcccaggcctggcctcggggcagggcagggcggctaggccggccagctcccccttgcccgccagccagtggccgaaccccccactccctgccaccgtcacacagtatttattgttcccacaatggctgggagggggcccttccagattgggggccctggggtccccactccctgtccatccccagttggggctgcgaccgccagattctcccttaaggaattgacttcagcaggggtgggaggctcccagacccagggcagtgtggtgggaggggtgttccaaagagaaggcctggtcagcagagccgccccgtgtccccccaggtgctggaggcagactcgagggccgaattgtttctagttaggccacgctcctctgttcagtcgcaaaggtgaacactcatgcggcccagccatgggccctctgagcaactgtgcagcaccctttcacccccaattaaacccagaaccact

SEQ ID NO: 308280 - DNA, 1008 bp, Homo sapiens
ggccagccccctgcctgggtcagcctctccctgcctgctgctctcctctggcccatccagcttgtatgtagattttccctcacgtgtgtgtgtgtgtgtgcgtgtgtgtgctggtgagagtgacagcgggagcagggatgtgagacctgcagggtggcagggctcatggatgactggcggggtgcattaagtgctcatgctcgtgaaaggcacctcttcttgggtgtgggtgaggacaggtgtgactgcgcatgcaggtatgtgtgaggagaggggttgtggggagcatgtgcgcctgtgaggggaggctttccaactgaagtgctgcctcccccgctggccagctctggagtcctccatcctgtctggtcaggccccccccaacccctgacctggcactcccattccgttccatgtccacaggctacatccagaagatcaagtcgggagaggaggactttgagtctctggcctcacagttcagcgactgcagctcagccaaggccaggggagacctgggtgccttcagcagaggtgcgcaaggaatgggcctcaccaggttgggggacccttaccaccctgaggggtagaggccaggagggtctgggcattgggctcccaggtgccacaccggccttcggggtccagcaggtggcagcacagccccttcctcaggcttcagaggctgctctgctgggcagggccagggccacacagggaggggggctgcagcactttcttcctggcatcatctctaccctggggggcatggtctcttgtgtgtctgtgcacagatgtcctcatcccaggcccaccaaggtgggtacatcctgtcctctgcctcttcctttttgtggtttaaggttgagggccctgagagtcccagggcctgtcccccagaatccctctcaaaggtggggaaaccaggggtgagaggaggtggccctgagtttaggcctgtctggccaggacagtggaaatcagggacagaggggactaggcctcctc

SEQ ID NO: 308281 - DNA, 1525 bp, Homo sapiens
atccggaccgttagggagcccaatgggcgtcgccgccaggccccgttgcagagcgcgtctagccaataggcagcggcggcgggcgggcgcgggcgacaggcggcgcagctgaggcggagcaggcgctgcggcaggagggaagatggcggacgaggagaagctgccgcccggctgggagaagcgcatgagccgcagctcaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggctacatccagaagatcaagtcgggagaggaggactttgagtctctggcctcacagttcagcgactgcagctcagccaaggccaggggagacctgggtgccttcagcagaggtcagatgcagaagccatttgaagacgcctcgtttgcgctgcggacgggggagatgagcgggcccgtgttcacggattccggcatccacatcatcctccgcactgagtgagggtggggagcccaggcctggcctcggggcagggcagggcggctaggccggccagctcccccttgcccgccagccagtggccgaaccccccactccctgccaccgtcacacagtatttattgttcccacaatggctgggagggggcccttccagattgggggccctggggtccccactccctgtccatccccagttggggctgcgaccgccagattctcccttaaggaattgacttcagcaggggtgggaggctcccagacccagggcagtgtggtgggaggggtgttccaaagagaaggcctggtcagcagagccgccccgtgtccccccaggtgctggaggcagactcgagggccgaattgtttctagttaggccacgctcctctgttcagtcgcaaaggtgaacactcatgcggcccagccatgggccctctgagcaactgtgcagcaccctttcacccccaattaaacccagaaccactaaaaaaaaaaacaacaaacgaaacagaaacaacaacaacagactcacacaaaagcgaaacaaagacctagcaatgaagacgaagcaaacacaagcgcaccgagagagggcgcgagcacagccacagaagaacagtcagccggcagggagacaacaaagaggcgagcacagcgccccgcgtgcacagcaagagggggcgcacaaagagggcggaagcacaaaagcgcgagcgaaggaggggccacgcgcagcgaaacgcagccgccgccgagacgcgagcacacaccaacccaccaaagcggacccagccccagagagcagccacccccaccacgcgagcagacgaaacaccacgagcgacacaaccatcccaagcacgcataacgcaccgacccacaaagaacaaact

SEQ ID NO: 308282 - DNA, 1899 bp, Homo sapiens
atccggaccgttagggagcccaatgggcgtcgccgccaggccccgttgcagagcgcgtctagccaataggcagcggcggcgggcgggcgcgggcgacaggcggcgcagctgaggcggagcaggcgctgcggcaggagggaagatggcggacgaggagaagctgccgcccggctgggagaagcgcatgagccgcagctcaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggctacatccagaagatcaagtcgggagaggaggactttgagtctctggcctcacagttcagcgactgcagctcagccaaggccaggggagacctgggtgccttcagcagaggtcagatgcagaagccatttgaagacgcctcgtttgcgctgcggacgggggagatgagcgggcccgtgttcacggattccggcatccacatcatcctccgcactgagtgagggtggggagcccaggcctggcctcggggcagggcagggcggctaggccggccagctcccccttgcccgccagccagtggccgaaccccccactccctgccaccgtcacacagtatttattgttcccacaatggctgggagggggcccttccagattgggggccctggggtccccactccctgtccatccccagttggggctgcgaccgccagattctcccttaaggaattgacttcagcaggggtgggaggctcccagacccagggcagtgtggtgggaggggtgttccaaagagaaggcctggtcagcagagccgccccgtgtccccccaggtgctggaggcagactcgagggccgaattgtttctagttaggccacgctcctctgttcagtcgcaaaggtgaacactcatgcggcccagccatgggccctctgagcaactgtgcagcaccctttcacccccaattaaacccagaaccactaaaaaaaaaaaaaaaaaaaaaaaaaaaaaaaaaaaaaaaaaaaaaaaaaaaaacaaaggggggggggcgcgagccaaaaaaatacccccacaggggggcgccccagtgtgacgcgacccacggagttttggtaacaaggggggcccacaaggggagggggcgcatttaagccacagggagcggggcccccgggataaaacaacggtggtggtggagaacacaccgcgcacggggaaaccttgggagaaaagaccccccacacgcgggggggggacacaacgtgcggcacacaccccgagagagagattgaaaggagaccagagggggggagaatagagcgcctgggagaggggcgaacagaggtgtgtacacacaaggcggaaaaatatcatcgtgggtttagaagaaattgtgcacgggagaatagatgggaagaattttaccgcggggggattatatttattataataggaggaaaaacaacgagagaagacacggagcacggggacaacaagaaaagaggggggagggggcgagggaaacgagcaccagtgcgcgggagagagaacgagggggagcccgacggcggagaagagcccacaggccacctacgctacccacacgacggagacgcggcacggacccgcacacgagggaggaacgaaagcgccgagagaaggacaaagaccagagcgcccgacaagcggaagagcgaagagaggggagggaagcaacgccgagcggcgcgggagaaggaggcgagcccagcgggcggagacgaa

SEQ ID NO: 308283 - DNA, 2590 bp, Homo sapiens
atccggaccgttagggagcccaatgggcgtcgccgccaggccccgttgcagagcgcgtctagccaataggcagcggcggcgggcgggcgcgggcgacaggcggcgcagctgaggcggagcaggcgctgcggcaggagggaagatggcggacgaggagaagctgccgcccggctgggagaagcgcatgagccgcagctcaggtgccgcgggggtcggggctggggcgggactgcgcgggcccgcgtaagcagggctcgagctcgccccttgggcgcggcggcagcgctgcctccctcccatggggtcctggctcttccgcgtcgtccccggggtaacggccccggcccgccctgttgtggggactgcgagcctcaggagccgccgggaagcctgaggaagctgaggcagggggctgggcgggtgagggtccggggagtccggggcgatggccctggccctgccggcccggctgatacctctcggcctaatgcacctgacaccccgggggacgtctctgcaccttgctgggcccgggggcacccctgggagggagacaccccagtaccctgcaaagggcgtagggtgttgcccggcctcgggtccacaacctacccctgctaacacccctactgtgtacacctaatgctgagtctgcgacatcgcccgtgacattctgccagacgatggcccctgtgcttaggcccgatttaagggttagccacaatgataatattgccagtaacagggcatgtttttctctgtgtcaagcgctttaagttctctctgaattgccgcaactctgggagccaggtagttattacttccaccttaccagcaaggaaactgaggtcagaaaactgaaggaactcgtccaagatcattcatttcaggggccgggggttggattaggacctaggcagtttgcctacaaatccccctccccgtgtcactgcaaactcctgaggagcaggcccagcatctgtgggcaggtcccgagtcactctgctgcctctagagcccatagcaatcgcatttgcaataataattctccttggttgagtgccaggttctggtgaactgtttggatacatggactctcctcattaaccccatgaggtttgatctccttattctctattccccatttttcagatgagaaaactgaggtgcagggagattagagcccattgccaaggttttagagtgagtcagtagctcagctgcatttgcacctggaacccgcgctctcgcccaccctgctctagccctggcctgtggctgggacctccagcataaaccggatgctctgcccagctctgggcccatttctgctgtttctgctcagttcaaccctgatggcttcctttatgggtgacactccatgtcacccaggcgaactgtcagcctttggagtggcacccagtagggtctttacttccagtttcttgttcacagtcttcactccttcatacccctcactccctgggtaacatcgggccaccagtaatgctggttcctagctctgcaacaccatgcacggtgtagtagctaagagcagagctttcgggtgtgaagtacctgagtacagttcctgccttcccctgtgtgtgcctggaacagagtaaacactcaggaagcgttacccactgctgccattcccagagatgcaaaaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggctacatccagaagatcaagtcgggagaggaggactttgagtctctggcctcacagttcagcgactgcagctcagccaaggccaggggagacctgggtgccttcagcagaggtcagatgcagaagccatttgaagacgcctcgtttgcgctgcggacgggggagatgagcgggcccgtgttcacggattccggcatccacatcatcctccgcactgagtgagggtggggagcccaggcctggcctcggggcagggcagggcggctaggccggccagctcccccttgcccgccagccagtggccgaaccccccactccctgccaccgtcacacagtatttattgttcccacaatggctgggagggggcccttccagattgggggccctggggtccccactccctgtccatccccagttggggctgcgaccgccagattctcccttaaggaattgacttcagcaggggtgggaggctcccagacccagggcagtgtggtgggaggggtgttccaaagagaaggcctggtcagcagagccgccccgtgtccccccaggtgctggaggcagactcgagggccgaattgtttctagttaggccacgctcctctgttcagtcgcaaaggtgaacactcatgcggcccagccatgggccctctgagcaactgtgcagcaccctttcacccccaattaaacccagaaccact

SEQ ID NO: 308284 - DNA, 1380 bp, Homo sapiens
caatgaccctaaggtaggaactgttatctccattttgcaggtgagaacaccaaggcccagggaagatatatcacatttgaacccagattcagatttgaatccaggtggcctggctgctgagtgcatggtttgagtcactccctgtcccccagcttcctctgttccatcactctgggttattttcctccttgaagttatcagggattgatactatcctgtgtttcatttgcttgtttagcacctgtctgctctcacctagaatgttagctctctaagggcagggactgtatcctgccacattggcccacgtctggagagcctgtggacatggtggatacaccatggatttgttgaatgaaggcgccccctgcaagccaggccctcaccctggcttctggctgtgggcccaggggtgtcctgggagcacaaccctagctgaattcctgcctgccctcccctccaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggctacatccagaagatcaagtcgggagaggaggactttgagtctctggcctcacagttcagcgactgcagctcagccaaggccaggggagacctgggtgccttcagcagaggtcagatgcagaagccatttgaagacgcctcgtttgcgctgcggacgggggagatgagcgggcccgtgttcacggattccggcatccacatcatcctccgcactgagtgagggtggggagcccaggcctggcctcggggcagggcagggcggctaggccggccagctcccccttgcccgccagccagtggccgaaccccccactccctgccaccgtcacacagtatttattgttcccacaatggctgggagggggcccttccagattgggggccctggggtccccactccctgtccatccccagttggggctgcgaccgccagattctcccttaaggaattgacttcagcaggggtgggaggctcccagacccagggcagtgtggtgggaggggtgttccaaagagaaggcctggtcagcagagccgccccgtgtccccccaggtgctggaggcagactcgagggccgaattgtttctagttaggccacgctcctctgttcagtcgcaaaggtgaacactcatgcggcccagccatgggccctctgagcaactgtgcagcaccctttcacccccaattaaacccagaaccact

SEQ ID NO: 308285 - DNA, 1638 bp, Homo sapiens
atccggaccgttagggagcccaatgggcgtcgccgccaggccccgttgcagagcgcgtctagccaataggcagcggcggcgggcgggcgcgggcgacaggcggcgcagctgaggcggagcaggcgctgcggcaggagggaagatggcggacgaggagaagctgccgcccggctgggagaagcgcatgagccgcagctcagatgagaaaactgaggtgcagggagattagagcccattgccaaggttttagagtgagtcagtagctcagctgcatttgcacctggaacccgcgctctcgcccaccctgctctagccctggcctgtggctgggacctccagcataaaccggatgctctgcccagctctgggcccatttctgctgtttctgctcagttcaaccctgatggcttcctttatgggtgacactccatgtcacccaggcgaactgtcagcctttggagtggcacccagtagggtctttacttccagtttcttgttcacagtcttcactccttcatacccctcactccctgggtaacatcgggccaccagtaatgctggttcctagctctgcaacaccatgcacggtgtagtagctaagagcagagctttcgggtgtgaagtacctgagtacagttcctgccttcccctgtgtgtgcctggaacagagtaaacactcaggaagcgttacccactgctgccattcccagagatgcaaaaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggctacatccagaagatcaagtcgggagaggaggactttgagtctctggcctcacagttcagcgactgcagctcagccaaggccaggggagacctgggtgccttcagcagaggtcagatgcagaagccatttgaagacgcctcgtttgcgctgcggacgggggagatgagcgggcccgtgttcacggattccggcatccacatcatcctccgcactgagtgagggtggggagcccaggcctggcctcggggcagggcagggcggctaggccggccagctcccccttgcccgccagccagtggccgaaccccccactccctgccaccgtcacacagtatttattgttcccacaatggctgggagggggcccttccagattgggggccctggggtccccactccctgtccatccccagttggggctgcgaccgccagattctcccttaaggaattgacttcagcaggggtgggaggctcccagacccagggcagtgtggtgggaggggtgttccaaagagaaggcctggtcagcagagccgccccgtgtccccccaggtgctggaggcagactcgagggccgaattgtttctagttaggccacgctcctctgttcagtcgcaaaggtgaacactcatgcggcccagccatgggccctctgagcaactgtgcagcaccctttcacccccaattaaacccagaaccact

SEQ ID NO: 308286 - DNA, 1359 bp, Homo sapiens
ctcctggcatcggtaaatgttctgtcattgttagtggtcactgtcattgctgttgttggttgtggtagcacagggcccagcacagagtgtacactcggtcagtattggctgttgttttactctctcatcacttggtccagttggcctgtaggatgttattttcctccttgaagttatcagggattgatactatcctgtgtttcatttgcttgtttagcacctgtctgctctcacctagaatgttagctctctaagggcagggactgtatcctgccacattggcccacgtctggagagcctgtggacatggtggatacaccatggatttgttgaatgaaggcgccccctgcaagccaggccctcaccctggcttctggctgtgggcccaggggtgtcctgggagcacaaccctagctgaattcctgcctgccctcccctccaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggctacatccagaagatcaagtcgggagaggaggactttgagtctctggcctcacagttcagcgactgcagctcagccaaggccaggggagacctgggtgccttcagcagaggtcagatgcagaagccatttgaagacgcctcgtttgcgctgcggacgggggagatgagcgggcccgtgttcacggattccggcatccacatcatcctccgcactgagtgagggtggggagcccaggcctggcctcggggcagggcagggcggctaggccggccagctcccccttgcccgccagccagtggccgaaccccccactccctgccaccgtcacacagtatttattgttcccacaatggctgggagggggcccttccagattgggggccctggggtccccactccctgtccatccccagttggggctgcgaccgccagattctcccttaaggaattgacttcagcaggggtgggaggctcccagacccagggcagtgtggtgggaggggtgttccaaagagaaggcctggtcagcagagccgccccgtgtccccccaggtgctggaggcagactcgagggccgaattgtttctagttaggccacgctcctctgttcagtcgcaaaggtgaacactcatgcggcccagccatgggccctctgagcaactgtgcagcaccctttcacccccaattaaacccagaaccact

SEQ ID NO: 308287 - DNA, 1063 bp, Homo sapiens
atccggaccgttagggagcccaatgggcgtcgccgccaggccccgttgcagagcgcgtctagccaataggcagcggcggcgggcgggcgcgggcgacaggcggcgcagctgaggcggagcaggcgctgcggcaggagggaagatggcggacgaggagaagctgccgcccggctgggagaagcgcatgagccgcagctcaggccgagtgtactacttcaaccacatcactaacgccagccagtgggagcggcccagcggcaacagcagcagtggtggcaacagccagtcacggcggccctcgtcctggcggcaggagaagatcacccggaccaaggaggaggccctggagctgatcaacggctacatccagaagatcaagtcgggagaggaggactttgagtctctggcctcacagttcagcgactgcagctcagccaaggccaggggagacctgggtgccttcagcagaggtcagatgcagaagccatttgaagacgcctcgtttgcgctgcggacgggggagatgagcgggcccgtgttcacggattccggcatccacatcatcctccgcactgagtgagggtggggagcccaggcctggcctcggggcagggcagggcggctaggccggccagctcccccttgcccgccagccagtggccgaaccccccactccctgccaccgtcacacagtatttattgttcccacaatggctgggagggggcccttccagattgggggccctggggtccccactccctgtccatccccagttggggctgcgaccgccagattctcccttaaggaattgacttcagcaggggtgggaggctcccagacccagggcagtgtggtgggaggggtgttccaaagagaaggcctggtcagcagagccgccccgtgtccccccaggtgctggaggcagactcgagggccgaattgtttctagttaggccacgctcctctgttcagtcgcaaaggtgaacactcatgcggcccagccatgggccctctgagcaactgtgcagcaccctttcacccccaattaaacccagaaccact

SEQ ID NO: 308288 - DNA, 1142 bp, Homo sapiens
atccggaccgttagggagcccaatgggcgtcgccgccaggccccgttgcagagcgcgtctagccaataggcagcggcggcgggcgggcgcgggcgacaggcggcgcagctgaggcggagcaggcgctgcggcaggagggaagatggcggacgaggagaagctgccgcccggctgggagaagcgcatgagccgcagctcaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggctacatccagaagatcaagtcgggagaggaggactttgagtctctggcctcacagttcagcgactgcagctcagccaaggccaggggagacctgggtgccttcagcagaggtgcgcaaggaatgggcctcaccaggtcagatgcagaagccatttgaagacgcctcgtttgcgctgcggacgggggagatgagcgggcccgtgttcacggattccggcatccacatcatcctccgcactgagtgagggtggggagcccaggcctggcctcggggcagggcagggcggctaggccggccagctcccccttgcccgccagccagtggccgaaccccccactccctgccaccgtcacacagtatttattgttcccacaatggctgggagggggcccttccagattgggggccctggggtccccactccctgtccatccccagttggggctgcgaccgccagattctcccttaaggaattgacttcagcaggggtgggaggctcccagacccagggcagtgtggtgggaggggtgttccaaagagaaggcctggtcagcagagccgccccgtgtccccccaggtgctggaggcagactcgagggccgaattgtttctagttaggccacgctcctctgttcagtcgcaaaggtgaacactcatgcggcccagccatgggccctctgagcaactgtgcagcaccctttcacccccaattaaacccagaaccact

SEQ ID NO: 308289 - DNA, 2615 bp, Homo sapiens
atccggaccgttagggagcccaatgggcgtcgccgccaggccccgttgcagagcgcgtctagccaataggcagcggcggcgggcgggcgcgggcgacaggcggcgcagctgaggcggagcaggcgctgcggcaggagggaagatggcggacgaggagaagctgccgcccggctgggagaagcgcatgagccgcagctcaggtgccgcgggggtcggggctggggcgggactgcgcgggcccgcgtaagcagggctcgagctcgccccttgggcgcggcggcagcgctgcctccctcccatggggtcctggctcttccgcgtcgtccccggggtaacggccccggcccgccctgttgtggggactgcgagcctcaggagccgccgggaagcctgaggaagctgaggcagggggctgggcgggtgagggtccggggagtccggggcgatggccctggccctgccggcccggctgatacctctcggcctaatgcacctgacaccccgggggacgtctctgcaccttgctgggcccgggggcacccctgggagggagacaccccagtaccctgcaaagggcgtagggtgttgcccggcctcgggtccacaacctacccctgctaacacccctactgtgtacacctaatgctgagtctgcgacatcgcccgtgacattctgccagacgatggcccctgtgcttaggcccgatttaagggttagccacaatgataatattgccagtaacagggcatgtttttctctgtgtcaagcgctttaagttctctctgaattgccgcaactctgggagccaggtagttattacttccaccttaccagcaaggaaactgaggtcagaaaactgaaggaactcgtccaagatcattcatttcaggggccgggggttggattaggacctaggcagtttgcctacaaatccccctccccgtgtcactgcaaactcctgaggagcaggcccagcatctgtgggcaggtcccgagtcactctgctgcctctagagcccatagcaatcgcatttgcaataataattctccttggttgagtgccaggttctggtgaactgtttggatacatggactctcctcattaaccccatgaggtttgatctccttattctctattccccatttttcagatgagaaaactgaggtgcagggagattagagcccattgccaaggttttagagtgagtcagtagctcagctgcatttgcacctggaacccgcgctctcgcccaccctgctctagccctggcctgtggctgggacctccagcataaaccggatgctctgcccagctctgggcccatttctgctgtttctgctcagttcaaccctgatggcttcctttatgggtgacactccatgtcacccaggcgaactgtcagcctttggagtggcacccagtagggtctttacttccagtttcttgttcacagtcttcactccttcatacccctcactccctgggtaacatcgggccaccagtaatgctggttcctagctctgcaacaccatgcacggtgtagtagctaagagcagagctttcgggtgtgaagtacctgagtacagttcctgccttcccctgtgtgtgcctggaacagagtaaacactcaggaagcgttacccactgctgccattcccagagatgcaaaaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggctacatccagaagatcaagtcgggagaggaggactttgagtctctggcctcacagttcagcgactgcagctcagccaaggccaggggagacctgggtgccttcagcagaggtgcgcaaggaatgggcctcaccaggtcagatgcagaagccatttgaagacgcctcgtttgcgctgcggacgggggagatgagcgggcccgtgttcacggattccggcatccacatcatcctccgcactgagtgagggtggggagcccaggcctggcctcggggcagggcagggcggctaggccggccagctcccccttgcccgccagccagtggccgaaccccccactccctgccaccgtcacacagtatttattgttcccacaatggctgggagggggcccttccagattgggggccctggggtccccactccctgtccatccccagttggggctgcgaccgccagattctcccttaaggaattgacttcagcaggggtgggaggctcccagacccagggcagtgtggtgggaggggtgttccaaagagaaggcctggtcagcagagccgccccgtgtccccccaggtgctggaggcagactcgagggccgaattgtttctagttaggccacgctcctctgttcagtcgcaaaggtgaacactcatgcggcccagccatgggccctctgagcaactgtgcagcaccctttcacccccaattaaacccagaaccact

SEQ ID NO: 308290 - DNA, 1055 bp, Homo sapiens
  misc_feature (913)..(913): n is a, c, g, or t
  misc_feature (972)..(972): n is a, c, g, or t
  misc_feature (982)..(982): n is a, c, g, or t
  misc_feature (1001)..(1001): n is a, c, g, or t
  misc_feature (1021)..(1021): n is a, c, g, or t
  misc_feature (1045)..(1045): n is a, c, g, or t
atccggaccgttagggagcccaatgggcgtcgccgccaggccccgttgcagagcgcgtctagccaataggcagcggcggcgggcgggcgcgggcgacaggcggcgcagctgaggcggagcaggcgctgcggcaggagggaagatggcggacgaggagaagctgccgcccggctgggagaagcgcatgagccgcagctcaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggctacatccagaagatcaagtcgggagaggaggactttgagtctctggcctcacagttcagcgactgcagctcagccaaggccaggggagacctgggtgccttcagcagaggtcagatgcagaagccatttgaagacgcctcgtttgcgctgcggacgggggagatgagcgggcccgtgttcacggattccggcatccacatcatcctccgcactgagtgagggtggggagcccaggcctggcctcggggcagggcagggcggctaggccggccagctcccccttgcccgccagccagtggccgaaccccccactccctgccaccgtcacacagtatttattgttcccacaatggctgggagggggcccttccagattgggggccctggggtccccactccctgtccatccccagttggggctgcgaccgccagattctcccttaaggaattgacttcagcaggggtgggaggctccccaaaaccaagggccattttttntttggaaagggtttttcccaaaaaaaaaaggcctggttccaccaaaaaccccccccttnttccccccangtttcttggaaagccaaanctccaaagggcccaaatttnttttcctatttttgggcccccctncctccttttt

SEQ ID NO: 308291 - DNA, 896 bp, Homo sapiens
atccggaccgttagggagcccaatgggcgtcgccgccaggccccgttgcagagcgcgtctagccaataggcagcggcggcgggcgggcgcgggcgacaggcggcgcagctgaggcggagcaggcgctgcggcaggagggaagatggcggacgaggagaagctgccgcccggctgggagaagcgcatgagccgcagctcaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggctacatccagaagatcaagtcgggagaggaggactttgagtctctggcctcacagttcagcgactgcagctcagccaaggccaggggagacctgggtgccttcagcagaggtcagatgcagaagccatttgaagacgcctcgtttgcgctgcggacgggggagatgagcgggcccgtgttcacggattccggcatccacatcatcctccgcactgagtgagggtggggagcccaggcctggcctcggggcagggcagggcggctaggccggccagctcccccttgcccgccagccagtggccgaaccccccactccctgccaccgtcacacagtgctggaggcagactcgagggccgaattgtttctagttaggccacgctcctctgttcagtcgcaaaggtgaacactcatgcggcccagccatgggccctctgagcaactgtgcagcaccctttcacccccaattaaacccagaaccact

SEQ ID NO: 308292 - DNA, 786 bp, Homo sapiens
atccggaccgttagggagcccaatgggcgtcgccgccaggccccgttgcagagcgcgtctagccaataggcagcggcggcgggcgggcgcgggcgacaggcggcgcagctgaggcggagcaggcgctgcggcaggagggaagatggcggacgaggagaagctgccgcccggctgggagaagcgcatgagccgcagctcaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggctacatccagaagatcaagtcgggagaggaggactttgagtctctggcctcacagttcagcgactgcagctcagccaaggccaggggagacctgggtgccttcagcagaggtcagatgcagaagccatttgaagacgcctcgtttgcgctgcggacgggggagatgagcgggcccgtgttcacggattccggcatccacatcatcctccgcactgagtgagggtgctggaggcagactcgagggccgaattgtttctagttaggccacgctcctctgttcagtcgcaaaggtgaacactcatgcggcccagccatgggccctctgagcaactgtgcagcaccctttcacccccaattaaacccagaaccact

SEQ ID NO: 308293 - DNA, 653 bp, Homo sapiens
atccggaccgttagggagcccaatgggcgtcgccgccaggccccgttgcagagcgcgtctagccaataggcagcggcggcgggcgggcgcgggcgacaggcggcgcagctgaggcggagcaggcgctgcggcaggagggaagatggcggacgaggagaagctgccgcccggctgggagaagcgcatgagccgcagctcaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggctacatccagaagatcaagtcgggagaggaggactttgagtctctggcctcacagttcaggtcagcagagccgccccgtgtccccccaggtgctggaggcagactcgagggccgaattgtttctagttaggccacgctcctctgttcagtcgcaaaggtgaacactcatgcggcccagccatgggccctctgagcaactgtgcagcaccctttcacccccaattaaacccagaaccact

SEQ ID NO: 308294 - DNA, 998 bp, Homo sapiens
atccggaccgttagggagcccaatgggcgtcgccgccaggccccgttgcagagcgcgtctagccaataggcagcggcggcgggcgggcgcgggcgacaggcggcgcagctgaggcggagcaggcgctgcggcaggagggaagatggcggacgaggagaagctgccgcccggctgggagaagcgcatgagccgcagctcaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggctacatccagaagatcaagtcgggagaggaggactttgagtctctggcctcacagttcagcgactgcagctcagccaaggccaggggagacctgggtgccttcagcagaggtgcgcaaggaatgggcctcaccaggttgggggacccttaccaccctgaggggtagaggccaggagggtctgggcattgggctcccaggtgccacaccggccttcggggtccagcaggtggcagcacagccccttcctcaggcttcagaggctgctctgctgggcagggccagggccacacagggaggggggctgcagcactttcttcctggcatcatctctaccctggggggcatggtctcttgtgtgtctgtgcacagatgtcctcatcccaggcccaccaaggtgggtacatcctgtcctctgcctcttcctttttgtggtttaaggttgagggccctgagagtcccagggcctgtcccccagaatccctctcaaaggtggggaaaccaggggtgagaggaggtggccctgagtttaggcctgtctggccaggacagtggaaatcagggacagaggggactaggcctcctc

SEQ ID NO: 308295 - DNA, 672 bp, Homo sapiens
atccggaccgttagggagcccaatgggcgtcgccgccaggccccgttgcagagcgcgtctagccaataggcagcggcggcgggcgggcgcgggcgacaggcggcgcagctgaggcggagcaggcgctgcggcaggagggaagatggcggacgaggagaagctgccgcccggctgggagaagcgcatgagccgcagctcaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggctacatccagaagatcaagtcgggagaggaggactttgagtctctggcctcacagttcagcgactgcagctcagccaaggtcagcagagccgccccgtgtccccccaggtgctggaggcagactcgagggccgaattgtttctagttaggccacgctcctctgttcagtcgcaaaggtgaacactcatgcggcccagccatgggccctctgagcaactgtgcagcaccctttcacccccaattaaacccagaaccact

SEQ ID NO: 308296 - DNA, 1733 bp, Homo sapiens
atccggaccgttagggagcccaatgggcgtcgccgccaggccccgttgcagagcgcgtctagccaataggcagcggcggcgggcgggcgcgggcgacaggcggcgcagctgaggcggagcaggcgctgcggcaggagggaagatggcggacgaggagaagctgccgcccggctgggagaagcgcatgagccgcagctcaggtgccgcgggggtcggggctggggcgggactgcgcgggcccgcgtaagcagggctcgagctcgccccttgggcgcggcggcagcgctgcctccctcccatggggtcctggctcttccgcgtcgtccccggggtaacggccccggcccgccctgttgtggggactgcgagcctcaggagccgccgggaagcctgaggaagctgaggcagggggctgggcgggtgagggtccggggagtccggggcgatggccctggccctgccggcccggctgatacctctcggcctaatgcacctgacaccccgggggacgtctctgcaccttgctgggcccgggggcacccctgggagggagacaccccagtaccctgcaaagggcgtagggtgttgcccggcctcgggtccacaacctacccctgctaacacccctactgtgtacacctaatgctgagtctgcgacatcgcccgtgacattctgccagacgatggcccctgtgcttaggcccgatttaagggttagccacaatgataatattgccagtaacagggcatgtttttctctgtgtcaagcgctttaagttctctctgaattgccgcaactctgggagccaggtagttattacttccaccttaccagcaaggaaactgaggtcagaaaactgaaggaactcgtccaagatcattcatttcaggggccgggggttggattaggacctaggcagtttgcctacaaatccccctccccgtgtcactgcaaactcctgaggagcaggcccagcatctgtgggcaggtcccgagtcactctgctgcctctagagcccatagcaatcgcatttgcaataataattctccttggttgagtgccaggttctggtgaactgtttggatacatggactctcctcattaaccccatgaggtttgatctccttattctctattccccatttttcagatgagaaaactgaggtgcagggagattagagcccattgccaaggttttagagtgagtcagtagctcagctgcatttgcacctggaacccgcgctctcgcccaccctgctctagccctggcctgtggctgggacctccagcataaaccggatgctctgcccagctctgggcccatttctgctgtttctgctcagttcaaccctgatggcttcctttatgggtgacactccatgtcacccaggcgaactgtcagcctttggagtggcacccagtagggtctttacttccagtttcttgttcacagtcttcactccttcatacccctcactccctgggtaacatcgggccaccagtaatgctggttcctagctctgcaacaccatgcacggtgtagtagctaagagcagagctttcgggtgtgaagtacctgagtacagttcctgccttcccctgtgtgtgcctggaacagagtaaacactcaggaagcgttacccactgctgccattcccagagatgcaaaaggtgaggtctccgttttgccatctatacaatagagataataaaggctatcccactcttaat

SEQ ID NO: 308297 - DNA, 839 bp, Homo sapiens
atccggaccgttagggagcccaatgggcgtcgccgccaggccccgttgcagagcgcgtctagccaataggcagcggcggcgggcgggcgcgggcgacaggcggcgcagctgaggcggagcaggcgctgcggcaggagggaagatggcggacgaggagaagctgccgcccggctgggagaagcgcatgagccgcagctcagagtaaacactcaggaagcgttacccactgctgccattcccagagatgcaaaaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggctacatccagaagatcaagtcgggagaggaggactttgagtctctggcctcacagttcagcgactgcagctcagccaaggccaggggagacctgggtgccttcagcagaggtcagatgcagaagccatttgaagacgcctcgtttgcgctgcggacgggggagatgagcgggcccgtgttcacggattccggcatccacatcatcctccgcactgagtgagggtgctggaggcagactcgagggccgaattgtttctagttaggccacgctcctctgttcagtcgcaaaggtgaacactcatgcggcccagccatgggccctctgagcaactgtgcagcaccctttcacccccaattaaacccagaaccact

SEQ ID NO: 308298 - DNA, 652 bp, Homo sapiens
  misc_feature (481)..(481): n is a, c, g, or t
ggtggccatgggaaaacatgtgtacagctgagtgggcagcacagcctgctggagcagccccagtgggattcagctgtggccatgggaaaacatgtgtacatctttggtggaatgactcctgcaggagcactggacacaatgtaccagtatcacacagaagagcagcattggaccttgcttaaatttgatactcttctaccccctggacgattggaccattccatgtgtatcattccatggccagtgacgtgtgcttctgagaaagaagattccaactctctcactctgaaccatgaagctgagaaagaggattcagctgacaaagtaatgagccacagtggtgactcacatgaggaaagccagactgctacactgctctgtttggtgtttggtgggatgaatacagaaggggaaatctatgacgattgtattgtgactgtagtggactaataaaacccacatttttaaaaaaaaaaaaaanaaaaaaaaaaaaaaaaaaacgggggctttttttggggggggggaaaaaggggtttgaaaggggcaggggctagggtttcctggaccccattttttgggcacaagggggaaattgggggggccccaaagggggggggataaatggaaaccggttaccgttgttctgggaaaa

SEQ ID NO: 308299 - DNA, 732 bp, Homo sapiens
aggcagggggtgaatcggcacgagggcgactggcctaagtcgccgcagaactgccacgtggggatgagatttgctgggctggtagcggcggctgctgcgggaggtcccgcccacgtgaagccagcctaactgagctctggactttggggacagctgtcagtggcctaggccgcaggacaccatgaagcaactgccagtcttggaacctggagacaagcccaggaaagcaacatggtacaccttgactgtccctggagacagcccctgtgctcgagttggccacagctgttcatatttacccccagttggtaatgccaagagagggaaggtcttcattgttgggggagcaaatccaaacagaagcttctcagacgtgcacaccatggatctggaaaccaggacgtggaccacgccagaagtgaccagccccccaccatccccaagaacattccacacatcatcggcagccattggaaaccagctatatgtctttgggggcggagagagaggtgcccagcccgtgcaggacacgaagctgcatgtgtttgacgcaagtatggactggtgggcaccttggggctggtcagggccatcccagtttacacattacctaatataggaagcagaagttagaaaaggaaagcctgactaagtgtctcacttctagacttctttgttatatctcttagctgatatctttttcccacagcaaaattggcatttaaaaaggga

SEQ ID NO: 308300 - DNA, 1713 bp, Homo sapiens
  misc_feature (1542)..(1542): n is a, c, g, or t
tgcagtccggggctggagggtaggggcgagggtccccggataccgggtctatcacagtctcgggcagggagtctgaatcttttaggggagtgggcccaagccgggtgcaaagaacggggaagggccttccctggctccgtcccggccactttgaccgaatcagcctgttctttcccgaccccgtctcctatcccctagaactgccacgtggggatgagatttgctgggctggtagcggcggctgctgcgggaggtcccgcccacgtgaagccagcctaactgagctctggactttggggacagctgtcagtggcctaggccgcaggacaccatgaagcaactgccagtcttggaacctggagacaagcccaggaaagcaacatggtacaccttgactgtccctggagacagcccctgtgctcgagttggccacagctgttcatatttacccccagttggtaatgccaagagagggaaggtcttcattgttgggggagcaaatccaaacagaagcttctcagacgtgcacaccatggatctgggaaaacaccagtgggacttagatacctgcaagggcctcttgccccggtatgaacatgctagcttcattccctcctgcacacctgaccgtatctgggtatttggaggtgccaaccaatcaggaaatcgaaattgtctacaagtcctgaatcctgaaaccaggacgtggaccacgccagaagtgaccagccccccaccatccccaagaacattccacacatcatcggcagccattggaaaccagctatatgtctttgggggcggagagagaggtgcccagcccgtgcaggacacgaagctgcatgtgtttgacgcaaacactctgacctggtcacagccagagacacttggaaatcctccatctccccggcatggtcatgtgatggtggcagcagggacaaagctcttcatccacggaggcttggcgggggacagattctatgatgacctccactgcattgatataagtgacatgaaatggcagaagctaaatcccactggggctgctccagcaggctgtgctgcccactcagctgtggccatgggaaaacatgtgtacatctttggtggaatgactcctgcaggagcactggacacaatgtaccagtatcacacagaagagcagcattggaccttgcttaaatttgatactcttctaccccctggacgattggaccattccatgtgtatcattccatggccagtgacgtgtgcttctgagaaagaagattccaactctctcactctgaaccatgaagctgagaaagaggattcagctgacaaagtaatgagccacagtggtgactcacatgaggaaagccagactgctacactgctctgtttggtgtttggtgggatgaatacagaaggggaaatctatgacgattgtattgtgactgtagtggactaataaaacccacatttttattacctgtcagttactttcagaatagttaagtaaaacattagctgttttatacctccaaaaaaaaaaaaaaaaanaaaaaaaaaaaaaaaaaaacgggggctttttttggggggggggaaaaaggggtttgaaaggggcaggggctagggtttcctggaccccattttttgggcacaagggggaaattgggggggccccaaagggggggggataaatggaaaccggttaccgttgttctgggaaaa

SEQ ID NO: 308301 - DNA, 1721 bp, Homo sapiens
  misc_feature (8)..(8): n is a, c, g, or t
  misc_feature (1550)..(1550): n is a, c, g, or t
agaggcgnagaacttaggctaggtcgggctggggcgagggtccccggataccgggtctatcacagtctcgggcagggagtctgaatcttttaggggagtgggcccaagccgggtgcaaagaacggggaagggccttccctggctccgtcccggccactttgaccgaatcagcctgttctttcccgaccccgtctcctatcccctagaactgccacgtggggatgagatttgctgggctggtagcggcggctgctgcgggaggtcccgcccacgtgaagccagcctaactgagctctggactttggggacagctgtcagtggcctaggccgcaggacaccatgaagcaactgccagtcttggaacctggagacaagcccaggaaagcaacatggtacaccttgactgtccctggagacagcccctgtgctcgagttggccacagctgttcatatttacccccagttggtaatgccaagagagggaaggtcttcattgttgggggagcaaatccaaacagaagcttctcagacgtgcacaccatggatctgggaaaacaccagtgggacttagatacctgcaagggcctcttgccccggtatgaacatgctagcttcattccctcctgcacacctgaccgtatctgggtatttggaggtgccaaccaatcaggaaatcgaaattgtctacaagtcctgaatcctgaaaccaggacgtggaccacgccagaagtgaccagccccccaccatccccaagaacattccacacatcatcggcagccattggaaaccagctatatgtctttgggggcggagagagaggtgcccagcccgtgcaggacacgaagctgcatgtgtttgacgcaaacactctgacctggtcacagccagagacacttggaaatcctccatctccccggcatggtcatgtgatggtggcagcagggacaaagctcttcatccacggaggcttggcgggggacagattctatgatgacctccactgcattgatataagtgacatgaaatggcagaagctaaatcccactggggctgctccagcaggctgtgctgcccactcagctgtggccatgggaaaacatgtgtacatctttggtggaatgactcctgcaggagcactggacacaatgtaccagtatcacacagaagagcagcattggaccttgcttaaatttgatactcttctaccccctggacgattggaccattccatgtgtatcattccatggccagtgacgtgtgcttctgagaaagaagattccaactctctcactctgaaccatgaagctgagaaagaggattcagctgacaaagtaatgagccacagtggtgactcacatgaggaaagccagactgctacactgctctgtttggtgtttggtgggatgaatacagaaggggaaatctatgacgattgtattgtgactgtagtggactaataaaacccacatttttattacctgtcagttactttcagaatagttaagtaaaacattagctgttttatacctccaaaaaaaaaaaaaaaaanaaaaaaaaaaaaaaaaaaacgggggctttttttggggggggggaaaaaggggtttgaaaggggcaggggctagggtttcctggaccccattttttgggcacaagggggaaattgggggggccccaaagggggggggataaatggaaaccggttaccgttgttctgggaaaa

SEQ ID NO: 308302 - DNA, 1570 bp, Homo sapiens
  misc_feature (1399)..(1399): n is a, c, g, or t
agccccgcccctccggggtggagtcacggctcgcgactggcctaagtcgccgcagaactgccacgtggggatgagatttgctgggctggtagcggcggctgctgcgggaggtcccgcccacgtgaagccagcctaactgagctctggactttggggacagctgtcagtggcctaggccgcaggacaccatgaagcaactgccagtcttggaacctggagacaagcccaggaaagcaacatggtacaccttgactgtccctggagacagcccctgtgctcgagttggccacagctgttcatatttacccccagttggtaatgccaagagagggaaggtcttcattgttgggggagcaaatccaaacagaagcttctcagacgtgcacaccatggatctgggaaaacaccagtgggacttagatacctgcaagggcctcttgccccggtatgaacatgctagcttcattccctcctgcacacctgaccgtatctgggtatttggaggtgccaaccaatcaggaaatcgaaattgtctacaagtcctgaatcctgaaaccaggacgtggaccacgccagaagtgaccagccccccaccatccccaagaacattccacacatcatcggcagccattggaaaccagctatatgtctttgggggcggagagagaggtgcccagcccgtgcaggacacgaagctgcatgtgtttgacgcaaacactctgacctggtcacagccagagacacttggaaatcctccatctccccggcatggtcatgtgatggtggcagcagggacaaagctcttcatccacggaggcttggcgggggacagattctatgatgacctccactgcattgatataagtgacatgaaatggcagaagctaaatcccactggggctgctccagcaggctgtgctgcccactcagctgtggccatgggaaaacatgtgtacatctttggtggaatgactcctgcaggagcactggacacaatgtaccagtatcacacagaagagcagcattggaccttgcttaaatttgatactcttctaccccctggacgattggaccattccatgtgtatcattccatggccagtgacgtgtgcttctgagaaagaagattccaactctctcactctgaaccatgaagctgagaaagaggattcagctgacaaagtaatgagccacagtggtgactcacatgaggaaagccagactgctacactgctctgtttggtgtttggtgggatgaatacagaaggggaaatctatgacgattgtattgtgactgtagtggactaataaaacccacatttttattacctgtcagttactttcagaatagttaagtaaaacattagctgttttatacctccaaaaaaaaaaaaaaaaanaaaaaaaaaaaaaaaaaaacgggggctttttttggggggggggaaaaaggggtttgaaaggggcaggggctagggtttcctggaccccattttttgggcacaagggggaaattgggggggccccaaagggggggggataaatggaaaccggttaccgttgttctgggaaaa

SEQ ID NO: 308303 - DNA, 1563 bp, Homo sapiens
  misc_feature (1392)..(1392): n is a, c, g, or t
aggcagggggtgaatcggcacgagggcgactggcctaagtcgccgcagaactgccacgtggggatgagatttgctgggctggtagcggcggctgctgcgggaggtcccgcccacgtgaagccagcctaactgagctctggactttggggacagctgtcagtggcctaggccgcaggacaccatgaagcaactgccagtcttggaacctggagacaagcccaggaaagcaacatggtacaccttgactgtccctggagacagcccctgtgctcgagttggccacagctgttcatatttacccccagttggtaatgccaagagagggaaggtcttcattgttgggggagcaaatccaaacagaagcttctcagacgtgcacaccatggatctgggaaaacaccagtgggacttagatacctgcaagggcctcttgccccggtatgaacatgctagcttcattccctcctgcacacctgaccgtatctgggtatttggaggtgccaaccaatcaggaaatcgaaattgtctacaagtcctgaatcctgaaaccaggacgtggaccacgccagaagtgaccagccccccaccatccccaagaacattccacacatcatcggcagccattggaaaccagctatatgtctttgggggcggagagagaggtgcccagcccgtgcaggacacgaagctgcatgtgtttgacgcaaacactctgacctggtcacagccagagacacttggaaatcctccatctccccggcatggtcatgtgatggtggcagcagggacaaagctcttcatccacggaggcttggcgggggacagattctatgatgacctccactgcattgatataagtgacatgaaatggcagaagctaaatcccactggggctgctccagcaggctgtgctgcccactcagctgtggccatgggaaaacatgtgtacatctttggtggaatgactcctgcaggagcactggacacaatgtaccagtatcacacagaagagcagcattggaccttgcttaaatttgatactcttctaccccctggacgattggaccattccatgtgtatcattccatggccagtgacgtgtgcttctgagaaagaagattccaactctctcactctgaaccatgaagctgagaaagaggattcagctgacaaagtaatgagccacagtggtgactcacatgaggaaagccagactgctacactgctctgtttggtgtttggtgggatgaatacagaaggggaaatctatgacgattgtattgtgactgtagtggactaataaaacccacatttttattacctgtcagttactttcagaatagttaagtaaaacattagctgttttatacctccaaaaaaaaaaaaaaaaanaaaaaaaaaaaaaaaaaaacgggggctttttttggggggggggaaaaaggggtttgaaaggggcaggggctagggtttcctggaccccattttttgggcacaagggggaaattgggggggccccaaagggggggggataaatggaaaccggttaccgttgttctgggaaaa

SEQ ID NO: 308304 - DNA, 1512 bp, Homo sapiens
  misc_feature (8)..(8): n is a, c, g, or t
agaggcgnagaacttaggctaggtcgggctggggcgagggtccccggataccgggtctatcacagtctcgggcagggagtctgaatcttttaggggagtgggcccaagccgggtgcaaagaacggggaagggccttccctggctccgtcccggccactttgaccgaatcagcctgttctttcccgaccccgtctcctatcccctagaactgccacgtggggatgagatttgctgggctggtagcggcggctgctgcgggaggtcccgcccacgtgaagccagcctaactgagctctggactttggggacagctgtcagtggcctaggccgcaggacaccatgaagcaactgccagtcttggaacctggagacaagcccaggaaagcaacatggtacaccttgactgtccctggagacagcccctgtgctcgagttggccacagctgttcatatttacccccagttggtaatgccaagagagggaaggtcttcattgttgggggagcaaatccaaacagaagcttctcagacgtgcacaccatggatctgggaaaacaccagtgggacttagatacctgcaagggcctcttgccccggtatgaacatgctagcttcattccctcctgcacacctgaccgtatctgggtatttggaggtgccaaccaatcaggaaatcgaaattgtctacaagtcctgaatcctgaaaccaggacgtggaccacgccagaagtgaccagccccccaccatccccaagaacattccacacatcatcggcagccattggaaaccagctatatgtctttgggggcggagagagaggtgcccagcccgtgcaggacacgaagctgcatgtgtttgacgcaaacactctgacctggtcacagccagagacacttggaaatcctccatctccccggcatggtcatgtgatggtggcagcagggacaaagctcttcatccacggaggcttggcgggggacagattctatgatgacctccactgcattgatataagtgacatgaaatggcagaagctaaatcccactggggctgctccagcaggctgtgctgcccactcagctgtggccatgggaaaacatgtgtacatctttggtggaatgactcctgcaggagcactggacacaatgtaccagtatcacacagagacggggtttcaccgtgttagccaggatggtctccatctcctgacctcgtgatccacccgcttcggcctcccaaagtgctgggattacaggcgtgagccaccgtgcccggcctatctggaaatttcttaacatgaagccttttccctccccaacataaagagcagcattggaccttgcttaaatttgatactcttctaccccctggacgattggaccattccatgtgtatcattccatggggcgcggactggggcttttgtaaaaaaaaattccccttttttactcttaaccttgagagtgaagaagaggttttctttgacaaattatggtgcaactggaggacta

SEQ ID NO: 308305 - DNA, 1662 bp, Homo sapiens
  misc_feature (8)..(8): n is a, c, g, or t
  misc_feature (1491)..(1491): n is a, c, g, or t
agaggcgnagaacttaggctaggtcgggctggggcgagggtccccggataccgggtctatcacagtctcgggcagggagtctgaatcttttaggggagtgggcccaagccgggtgcaaagaacggggaagggccttccctggctccgtcccggccactttgaccgaatcagcctgttctttcccgaccccgtctcctatcccctagaactgccacgtggggatgagatttgctgggctggtagcggcggctgctgcgggaggtcccgcccacgtgaagccagcctaactgagctctggactttggggacagctgtcagtggcctaggccgcaggtacaccttgactgtccctggagacagcccctgtgctcgagttggccacagctgttcatatttacccccagttggtaatgccaagagagggaaggtcttcattgttgggggagcaaatccaaacagaagcttctcagacgtgcacaccatggatctgggaaaacaccagtgggacttagatacctgcaagggcctcttgccccggtatgaacatgctagcttcattccctcctgcacacctgaccgtatctgggtatttggaggtgccaaccaatcaggaaatcgaaattgtctacaagtcctgaatcctgaaaccaggacgtggaccacgccagaagtgaccagccccccaccatccccaagaacattccacacatcatcggcagccattggaaaccagctatatgtctttgggggcggagagagaggtgcccagcccgtgcaggacacgaagctgcatgtgtttgacgcaaacactctgacctggtcacagccagagacacttggaaatcctccatctccccggcatggtcatgtgatggtggcagcagggacaaagctcttcatccacggaggcttggcgggggacagattctatgatgacctccactgcattgatataagtgacatgaaatggcagaagctaaatcccactggggctgctccagcaggctgtgctgcccactcagctgtggccatgggaaaacatgtgtacatctttggtggaatgactcctgcaggagcactggacacaatgtaccagtatcacacagaagagcagcattggaccttgcttaaatttgatactcttctaccccctggacgattggaccattccatgtgtatcattccatggccagtgacgtgtgcttctgagaaagaagattccaactctctcactctgaaccatgaagctgagaaagaggattcagctgacaaagtaatgagccacagtggtgactcacatgaggaaagccagactgctacactgctctgtttggtgtttggtgggatgaatacagaaggggaaatctatgacgattgtattgtgactgtagtggactaataaaacccacatttttattacctgtcagttactttcagaatagttaagtaaaacattagctgttttatacctccaaaaaaaaaaaaaaaaanaaaaaaaaaaaaaaaaaaacgggggctttttttggggggggggaaaaaggggtttgaaaggggcaggggctagggtttcctggaccccattttttgggcacaagggggaaattgggggggccccaaagggggggggataaatggaaaccggttaccgttgttctgggaaaa

SEQ ID NO: 308306 - DNA, 1342 bp, Homo sapiens
  misc_feature (1171)..(1171): n is a, c, g, or t
agccccgcccctccggggtggagtcacggctcgcgactggcctaagtcgccgcagaactgccacgtggggatgagatttgctgggctggtagcggcggctgctgcgggaggtcccgcccacgtgaagccagcctaactgaggcttctcagacgtgcacaccatggatctgggaaaacaccagtgggacttagatacctgcaagggcctcttgccccggtatgaacatgctagcttcattccctcctgcacacctgaccgtatctgggtatttggaggtgccaaccaatcaggaaatcgaaattgtctacaagtcctgaatcctgaaaccaggacgtggaccacgccagaagtgaccagccccccaccatccccaagaacattccacacatcatcggcagccattggaaaccagctatatgtctttgggggcggagagagaggtgcccagcccgtgcaggacacgaagctgcatgtgtttgacgcaaacactctgacctggtcacagccagagacacttggaaatcctccatctccccggcatggtcatgtgatggtggcagcagggacaaagctcttcatccacggaggcttggcgggggacagattctatgatgacctccactgcattgatataagtgacatgaaatggcagaagctaaatcccactggggctgctccagcaggctgtgctgcccactcagctgtggccatgggaaaacatgtgtacatctttggtggaatgactcctgcaggagcactggacacaatgtaccagtatcacacagaagagcagcattggaccttgcttaaatttgatactcttctaccccctggacgattggaccattccatgtgtatcattccatggccagtgacgtgtgcttctgagaaagaagattccaactctctcactctgaaccatgaagctgagaaagaggattcagctgacaaagtaatgagccacagtggtgactcacatgaggaaagccagactgctacactgctctgtttggtgtttggtgggatgaatacagaaggggaaatctatgacgattgtattgtgactgtagtggactaataaaacccacatttttattacctgtcagttactttcagaatagttaagtaaaacattagctgttttatacctccaaaaaaaaaaaaaaaaanaaaaaaaaaaaaaaaaaaacgggggctttttttggggggggggaaaaaggggtttgaaaggggcaggggctagggtttcctggaccccattttttgggcacaagggggaaattgggggggccccaaagggggggggataaatggaaaccggttaccgttgttctgggaaaa

SEQ ID NO: 308307 - DNA, 1667 bp, Homo sapiens
  misc_feature (8)..(8): n is a, c, g, or t
  misc_feature (1496)..(1496): n is a, c, g, or t
agaggcgnagaacttaggctaggtcgggctggggcgagggtccccggataccgggtctatcacagtctcgggcagggagtctgaatcttttaggggagtgggcccaagccgggtgcaaagaacggggaagggccttccctggctccgtcccggccactttgaccgaatcagcctgttctttcccgaccccgtctcctatcccctagaactgccacgtggggatgagatttgctgggctggtagcggcggctgctgcgggaggtcccgcccacgtgaagccagcctaactgagctctggactttggggacagctgtcagtggcctaggccgcaggacaccatgaagcaactgccagtcttggaacctggagacaagcccaggaaagcaacatggtacaccttgactgtccctggagacagcccctgtgctcgagttggccacagctgttcatatttacccccagttggtaatgccaagagagggaaggtcttcattgttgggggagcaaatccaaacagaagcttctcagacgtgcacaccatggatctggatgctagcttcattccctcctgcacacctgaccgtatctgggtatttggaggtgccaaccaatcaggaaatcgaaattgtctacaagtcctgaatcctgaaaccaggacgtggaccacgccagaagtgaccagccccccaccatccccaagaacattccacacatcatcggcagccattggaaaccagctatatgtctttgggggcggagagagaggtgcccagcccgtgcaggacacgaagctgcatgtgtttgacgcaaacactctgacctggtcacagccagagacacttggaaatcctccatctccccggcatggtcatgtgatggtggcagcagggacaaagctcttcatccacggaggcttggcgggggacagattctatgatgacctccactgcattgatataagtgacatgaaatggcagaagctaaatcccactggggctgctccagcaggctgtgctgcccactcagctgtggccatgggaaaacatgtgtacatctttggtggaatgactcctgcaggagcactggacacaatgtaccagtatcacacagaagagcagcattggaccttgcttaaatttgatactcttctaccccctggacgattggaccattccatgtgtatcattccatggccagtgacgtgtgcttctgagaaagaagattccaactctctcactctgaaccatgaagctgagaaagaggattcagctgacaaagtaatgagccacagtggtgactcacatgaggaaagccagactgctacactgctctgtttggtgtttggtgggatgaatacagaaggggaaatctatgacgattgtattgtgactgtagtggactaataaaacccacatttttattacctgtcagttactttcagaatagttaagtaaaacattagctgttttatacctccaaaaaaaaaaaaaaaaanaaaaaaaaaaaaaaaaaaacgggggctttttttggggggggggaaaaaggggtttgaaaggggcaggggctagggtttcctggaccccattttttgggcacaagggggaaattgggggggccccaaagggggggggataaatggaaaccggttaccgttgttctgggaaaa

SEQ ID NO: 308308 - DNA, 1568 bp, Homo sapiens
  misc_feature (8)..(8): n is a, c, g, or t
  misc_feature (1397)..(1397): n is a, c, g, or t
agaggcgnagaacttaggctaggtcgggctggggcgagggtccccggataccgggtctatcacagtctcgggcagggagtctgaatcttttaggggagtgggcccaagccgggtgcaaagaacggggaagggccttccctggctccgtcccggccactttgaccgaatcagcctgttctttcccgaccccgtctcctatcccctagaactgccacgtggggatgagatttgctgggctggtagcggcggctgctgcgggaggtcccgcccacgtgaagccagcctaactgagctctggactttggggacagctgtcagtggcctaggccgcaggacaccatgaagcaactgccagtcttggaacctggagacaagcccaggaaagcaacatggtacaccttgactgtccctggagacagcccctgtgctcgagttggccacagctgttcatatttacccccagttggtaatgccaagagagggaaggtcttcattgttgggggagcaaatccaaacagaagcttctcagacgtgcacaccatggatctggaaaccaggacgtggaccacgccagaagtgaccagccccccaccatccccaagaacattccacacatcatcggcagccattggaaaccagctatatgtctttgggggcggagagagaggtgcccagcccgtgcaggacacgaagctgcatgtgtttgacgcaaacactctgacctggtcacagccagagacacttggaaatcctccatctccccggcatggtcatgtgatggtggcagcagggacaaagctcttcatccacggaggcttggcgggggacagattctatgatgacctccactgcattgatataagtgacatgaaatggcagaagctaaatcccactggggctgctccagcaggctgtgctgcccactcagctgtggccatgggaaaacatgtgtacatctttggtggaatgactcctgcaggagcactggacacaatgtaccagtatcacacagaagagcagcattggaccttgcttaaatttgatactcttctaccccctggacgattggaccattccatgtgtatcattccatggccagtgacgtgtgcttctgagaaagaagattccaactctctcactctgaaccatgaagctgagaaagaggattcagctgacaaagtaatgagccacagtggtgactcacatgaggaaagccagactgctacactgctctgtttggtgtttggtgggatgaatacagaaggggaaatctatgacgattgtattgtgactgtagtggactaataaaacccacatttttattacctgtcagttactttcagaatagttaagtaaaacattagctgttttatacctccaaaaaaaaaaaaaaaaanaaaaaaaaaaaaaaaaaaacgggggctttttttggggggggggaaaaaggggtttgaaaggggcaggggctagggtttcctggaccccattttttgggcacaagggggaaattgggggggccccaaagggggggggataaatggaaaccggttaccgttgttctgggaaaa

SEQ ID NO: 308309 - DNA, 1551 bp, Homo sapiens
  misc_feature (1380)..(1380): n is a, c, g, or t
tgcagtccggggctggagggtaggggcgagggtccccggataccgggtctatcacagtctcgggcagggagtctgaatcttttaggggagtgggcccaagccgggtgcaaagaacggggaagggccttccctggctccgtcccggccactttgaccgaatcagcctgttctttcccgaccccgtctcctatcccctagaactgccacgtggggatgagatttgctgggctggtagcggcggctgctgcgggaggtcccgcccacgtgaagccagcctaactgagctctggactttggggacagctgtcagtggcctaggccgcaggacaccatgaagcaactgccagtcttggaacctggagacaagcccaggaaagcaacatggtacaccttgactgtccctggagacagcccctgtgctcgagttggccacagctgttcatatttacccccagttggtaatgccaagagagggaaggtcttcattgttgggggagcaaatccaaacagaagcttctcagacgtgcacaccatggatctgggaaaacaccagtgggacttagatacctgcaagggcctcttgccccggtatgaacatgctagcttcattccctcctgcacacctgaccgtatctgggtatttggaggtgccaaccaatcaggaaatcgaaattgtctacaagtcctgaatcctgacactctgacctggtcacagccagagacacttggaaatcctccatctccccggcatggtcatgtgatggtggcagcagggacaaagctcttcatccacggaggcttggcgggggacagattctatgatgacctccactgcattgatataagtgacatgaaatggcagaagctaaatcccactggggctgctccagcaggctgtgctgcccactcagctgtggccatgggaaaacatgtgtacatctttggtggaatgactcctgcaggagcactggacacaatgtaccagtatcacacagaagagcagcattggaccttgcttaaatttgatactcttctaccccctggacgattggaccattccatgtgtatcattccatggccagtgacgtgtgcttctgagaaagaagattccaactctctcactctgaaccatgaagctgagaaagaggattcagctgacaaagtaatgagccacagtggtgactcacatgaggaaagccagactgctacactgctctgtttggtgtttggtgggatgaatacagaaggggaaatctatgacgattgtattgtgactgtagtggactaataaaacccacatttttattacctgtcagttactttcagaatagttaagtaaaacattagctgttttatacctccaaaaaaaaaaaaaaaaanaaaaaaaaaaaaaaaaaaacgggggctttttttggggggggggaaaaaggggtttgaaaggggcaggggctagggtttcctggaccccattttttgggcacaagggggaaattgggggggccccaaagggggggggataaatggaaaccggttaccgttgttctgggaaaa

SEQ ID NO: 308310 - DNA, 1410 bp, Homo sapiens
  misc_feature (8)..(8): n is a, c, g, or t
  misc_feature (1239)..(1239): n is a, c, g, or t
agaggcgnagaacttaggctaggtcgggctggggcgagggtccccggataccgggtctatcacagtctcgggcagggagtctgaatcttttaggggagtgggcccaagccgggtgcaaagaacggggaagggccttccctggctccgtcccggccactttgaccgaatcagcctgttctttcccgaccccgtctcctatcccctagaactgccacgtggggatgagatttgctgggctggtagcggcggctgctgcgggaggtcccgcccacgtgaagccagcctaactgagctctggactttggggacagctgtcagtggcctaggccgcaggacaccatgaagcaactgccagtcttggaacctggagacaagcccaggaaagcaacatgaaaccaggacgtggaccacgccagaagtgaccagccccccaccatccccaagaacattccacacatcatcggcagccattggaaaccagctatatgtctttgggggcggagagagaggtgcccagcccgtgcaggacacgaagctgcatgtgtttgacgcaaacactctgacctggtcacagccagagacacttggaaatcctccatctccccggcatggtcatgtgatggtggcagcagggacaaagctcttcatccacggaggcttggcgggggacagattctatgatgacctccactgcattgatataagtgacatgaaatggcagaagctaaatcccactggggctgctccagcaggctgtgctgcccactcagctgtggccatgggaaaacatgtgtacatctttggtggaatgactcctgcaggagcactggacacaatgtaccagtatcacacagaagagcagcattggaccttgcttaaatttgatactcttctaccccctggacgattggaccattccatgtgtatcattccatggccagtgacgtgtgcttctgagaaagaagattccaactctctcactctgaaccatgaagctgagaaagaggattcagctgacaaagtaatgagccacagtggtgactcacatgaggaaagccagactgctacactgctctgtttggtgtttggtgggatgaatacagaaggggaaatctatgacgattgtattgtgactgtagtggactaataaaacccacatttttattacctgtcagttactttcagaatagttaagtaaaacattagctgttttatacctccaaaaaaaaaaaaaaaaanaaaaaaaaaaaaaaaaaaacgggggctttttttggggggggggaaaaaggggtttgaaaggggcaggggctagggtttcctggaccccattttttgggcacaagggggaaattgggggggccccaaagggggggggataaatggaaaccggttaccgttgttctgggaaaa

SEQ ID NO: 308311 - DNA, 1406 bp, Homo sapiens
  misc_feature (8)..(8): n is a, c, g, or t
  misc_feature (1235)..(1235): n is a, c, g, or t
agaggcgnagaacttaggctaggtcgggctggggcgagggtccccggataccgggtctatcacagtctcgggcagggagtctgaatcttttaggggagtgggcccaagccgggtgcaaagaacggggaagggccttccctggctccgtcccggccactttgaccgaatcagcctgttctttcccgaccccgtctcctatcccctagaactgccacgtggggatgagatttgctgggctggtagcggcggctgctgcgggaggtcccgcccacgtgaagccagcctaactgagctctggactttggggacagctgtcagtggcctaggccgcaggacaccatgaagcaactgccagtcttggaacctggagacaagcccaggaaagcaacatggtacaccttgactgtccctggagacagcccctgtgctcgagttggccacagctgttcatatttacccccagttggtaatgccaagagagggaaggtcttcattgttgggggagcaaatccaaacagaagcttctcagacgtgcacaccatggatctggacactctgacctggtcacagccagagacacttggaaatcctccatctccccggcatggtcatgtgatggtggcagcagggacaaagctcttcatccacggaggcttggcgggggacagattctatgatgacctccactgcattgatataagtgacatgaaatggcagaagctaaatcccactggggctgctccagcaggctgtgctgcccactcagctgtggccatgggaaaacatgtgtacatctttggtggaatgactcctgcaggagcactggacacaatgtaccagtatcacacagaagagcagcattggaccttgcttaaatttgatactcttctaccccctggacgattggaccattccatgtgtatcattccatggccagtgacgtgtgcttctgagaaagaagattccaactctctcactctgaaccatgaagctgagaaagaggattcagctgacaaagtaatgagccacagtggtgactcacatgaggaaagccagactgctacactgctctgtttggtgtttggtgggatgaatacagaaggggaaatctatgacgattgtattgtgactgtagtggactaataaaacccacatttttattacctgtcagttactttcagaatagttaagtaaaacattagctgttttatacctccaaaaaaaaaaaaaaaaanaaaaaaaaaaaaaaaaaaacgggggctttttttggggggggggaaaaaggggtttgaaaggggcaggggctagggtttcctggaccccattttttgggcacaagggggaaattgggggggccccaaagggggggggataaatggaaaccggttaccgttgttctgggaaaa

SEQ ID NO: 308312 - DNA, 1248 bp, Homo sapiens
  misc_feature (8)..(8): n is a, c, g, or t
  misc_feature (1077)..(1077): n is a, c, g, or t
agaggcgnagaacttaggctaggtcgggctggggcgagggtccccggataccgggtctatcacagtctcgggcagggagtctgaatcttttaggggagtgggcccaagccgggtgcaaagaacggggaagggccttccctggctccgtcccggccactttgaccgaatcagcctgttctttcccgaccccgtctcctatcccctagaactgccacgtggggatgagatttgctgggctggtagcggcggctgctgcgggaggtcccgcccacgtgaagccagcctaactgagctctggactttggggacagctgtcagtggcctaggccgcaggacaccatgaagcaactgccagtcttggaacctggagacaagcccaggaaagcaacatgacactctgacctggtcacagccagagacacttggaaatcctccatctccccggcatggtcatgtgatggtggcagcagggacaaagctcttcatccacggaggcttggcgggggacagattctatgatgacctccactgcattgatataagtgacatgaaatggcagaagctaaatcccactggggctgctccagcaggctgtgctgcccactcagctgtggccatgggaaaacatgtgtacatctttggtggaatgactcctgcaggagcactggacacaatgtaccagtatcacacagaagagcagcattggaccttgcttaaatttgatactcttctaccccctggacgattggaccattccatgtgtatcattccatggccagtgacgtgtgcttctgagaaagaagattccaactctctcactctgaaccatgaagctgagaaagaggattcagctgacaaagtaatgagccacagtggtgactcacatgaggaaagccagactgctacactgctctgtttggtgtttggtgggatgaatacagaaggggaaatctatgacgattgtattgtgactgtagtggactaataaaacccacatttttattacctgtcagttactttcagaatagttaagtaaaacattagctgttttatacctccaaaaaaaaaaaaaaaaanaaaaaaaaaaaaaaaaaaacgggggctttttttggggggggggaaaaaggggtttgaaaggggcaggggctagggtttcctggaccccattttttgggcacaagggggaaattgggggggccccaaagggggggggataaatggaaaccggttaccgttgttctgggaaaa

SEQ ID NO: 308313 - DNA, 1204 bp, Homo sapiens
  misc_feature (8)..(8): n is a, c, g, or t
  misc_feature (1033)..(1033): n is a, c, g, or t
agaggcgnagaacttaggctaggtcgggctggggcgagggtccccggataccgggtctatcacagtctcgggcagggagtctgaatcttttaggggagtgggcccaagccgggtgcaaagaacggggaagggccttccctggctccgtcccggccactttgaccgaatcagcctgttctttcccgaccccgtctcctatcccctagaactgccacgtggggatgagatttgctgggctggtagcggcggctgctgcgggaggtcccgcccacgtgaagccagcctaactgagctctggactttggggacagctgtcagtggcctaggccgcaggacaccatgaagcaactgccagtcttggaacctggagacaagcccaggaaagcaacatggtacaccttgactgtccctggagacagcccctgtgctcgagttggccacagctgttcatatttacccccagttggtaatgccaagagagggaaggtcttcattgttgggggagcaaatccaaacagaagcttctcagacgtgcacaccatggatctgggaaaacaccagtgggacttagatacctgcaagggcctcttgccccggtatgaacatgctagcttcattccctcctgcacacctgaccgtatctgggtatttggaggtgccaaccaatcaggaaatcgaaattgtctacaagtcctgaatcctgaaaccaggacgtggaccacgccagaagtgaccagccccccaccatccccaagaacaattccaactctctcactctgaaccatgaagctgagaaagaggattcagctgacaaagtaatgagccacagtggtgactcacatgaggaaagccagactgctacactgctctgtttggtgtttggtgggatgaatacagaaggggaaatctatgacgattgtattgtgactgtagtggactaataaaacccacatttttattacctgtcagttactttcagaatagttaagtaaaacattagctgttttatacctccaaaaaaaaaaaaaaaaanaaaaaaaaaaaaaaaaaaacgggggctttttttggggggggggaaaaaggggtttgaaaggggcaggggctagggtttcctggaccccattttttgggcacaagggggaaattgggggggccccaaagggggggggataaatggaaaccggttaccgttgttctgggaaaa

SEQ ID NO: 308314 - DNA, 1009 bp, Homo sapiens
  misc_feature (8)..(8): n is a, c, g, or t
  misc_feature (838)..(838): n is a, c, g, or t
agaggcgnagaacttaggctaggtcgggctggggcgagggtccccggataccgggtctatcacagtctcgggcagggagtctgaatcttttaggggagtgggcccaagccgggtgcaaagaacggggaagggccttccctggctccgtcccggccactttgaccgaatcagcctgttctttcccgaccccgtctcctatcccctagaactgccacgtggggatgagatttgctgggctggtagcggcggctgctgcgggaggtcccgcccacgtgaagccagcctaactgagctctggactttggggacactgttcatatttacccccagttggtaatgccaagagagggaaggtcttcattgttgggggagcaaatccaaacagaaatgtgtacatctttggtggaatgactcctgcaggagcactggacacaatgtaccagtatcacacagaagagcagcattggaccttgcttaaatttgatactcttctaccccctggacgattggaccattccatgtgtatcattccatggccagtgacgtgtgcttctgagaaagaagattccaactctctcactctgaaccatgaagctgagaaagaggattcagctgacaaagtaatgagccacagtggtgactcacatgaggaaagccagactgctacactgctctgtttggtgtttggtgggatgaatacagaaggggaaatctatgacgattgtattgtgactgtagtggactaataaaacccacatttttattacctgtcagttactttcagaatagttaagtaaaacattagctgttttatacctccaaaaaaaaaaaaaaaaanaaaaaaaaaaaaaaaaaaacgggggctttttttggggggggggaaaaaggggtttgaaaggggcaggggctagggtttcctggaccccattttttgggcacaagggggaaattgggggggccccaaagggggggggataaatggaaaccggttaccgttgttctgggaaaa

SEQ ID NO: 308315 - DNA, 1155 bp, Homo sapiens
  misc_feature (8)..(8): n is a, c, g, or t
agaggcgnagaacttaggctaggtcgggctggggcgagggtccccggataccgggtctatcacagtctcgggcagggagtctgaatcttttaggggagtgggcccaagccgggtgcaaagaacggggaagggccttccctggctccgtcccggccactttgaccgaatcagcctgttctttcccgaccccgtctcctatcccctagaactgccacgtggggatgagatttgctgggctggtagcggcggctgctgcgggaggtcccgcccacgtgaagccagcctaactgagctctggactttggggacactgttcatatttacccccagttggtaatgccaagagagggaaggtcttcattgttgggggagcaaatccaaacagaaatgtgtacatctttggtggaatgactcctgcaggagcactggacacaatgtaccagtatcacacagaagagcagcattggaccttgcttaaatttgatactcttctaccccctggacgattggaccattccatgtgtatcattccatggccagtgacgtgtgcttctgagaaagaagattccaactctctcactctgaaccatgaagctgagaaagaggattcagctgacaaagtaatgagccacagtggtgactcacatgaggaaagccagactgctacactgctctgtttggtgtttggtgggatgaatacagaaggggaaatctatgacgattgtattgtgactgtagtggactaataaaacccacatttttaaaaaacacaccccaaccaaaacccaaaacacacttttggggcccctgggcccctggaaaactcttttgaagaacaattccgtttgggcacgccgggccaccaaaaggaaaggagacacagtgcaaaagcgtggtacccaaagaggggaaccaccccgggcgagacgacaggacatgagaagcgagtcggaaaactctacacacacgcaagtaaagaaaaacggcccgccgggtggggaaaacacgagcccgagctgtctaccgacaaaaccgaaacaccaccaagcaaagggggaatcaagagaggaggtgcacacaaaaggggggccacgaagaacaaacaggggacgcaccaaagagcagaacgctccggattaccaaaatatcacgacc

SEQ ID NO: 308316 - DNA, 918 bp, Homo sapiens
  misc_feature (747)..(747): n is a, c, g, or t
aggcagggggtgaatcggcacgagggcgactggcctaagtcgccgcagaactgccacgtggggatgagatttgctgggctggtagcggcggctgctgcgggaggtcccgcccacgtgaagccagcctaactgagctctggactttggggacagctgtcagtggcctaggccgcaggacaccatgaagcaactgccagtcttggaacctggagacaagcccaggaaagcaacatggtacaccttgactgtccctggagacagcccctgtgctcgagttggccacagctgttcatatttacccccagttggtaatgccaagagagggaaggtcttcattgttgggggagcaaatccaaacagaaaagagcagcattggaccttgcttaaatttgatactcttctaccccctggacgattggaccattccatgtgtatcattccatggccagtgacgtgtgcttctgagaaagaagattccaactctctcactctgaaccatgaagctgagaaagaggattcagctgacaaagtaatgagccacagtggtgactcacatgaggaaagccagactgctacactgctctgtttggtgtttggtgggatgaatacagaaggggaaatctatgacgattgtattgtgactgtagtggactaataaaacccacatttttattacctgtcagttactttcagaatagttaagtaaaacattagctgttttatacctccaaaaaaaaaaaaaaaaanaaaaaaaaaaaaaaaaaaacgggggctttttttggggggggggaaaaaggggtttgaaaggggcaggggctagggtttcctggaccccattttttgggcacaagggggaaattgggggggccccaaagggggggggataaatggaaaccggttaccgttgttctgggaaaa

SEQ ID NO: 308317 - DNA, 1051 bp, Homo sapiens
  misc_feature (8)..(8): n is a, c, g, or t
  misc_feature (880)..(880): n is a, c, g, or t
agaggcgnagaacttaggctaggtcgggctggggcgagggtccccggataccgggtctatcacagtctcgggcagggagtctgaatcttttaggggagtgggcccaagccgggtgcaaagaacggggaagggccttccctggctccgtcccggccactttgaccgaatcagcctgttctttcccgaccccgtctcctatcccctagaactgccacgtggggatgagatttgctgggctggtagcggcggctgctgcgggaggtcccgcccacgtgaagccagcctaactgagctctggactttggggacagctgtcagtggcctaggccgcaggacaccatgaagcaactgccagtcttggaacctggagacaagcccaggaaagcaacatggtacaccttgactgtccctggagacagcccctgtgctcgagttggccacagctgttcatatttacccccagttggtaatgccaagagagggaaggtcttcattgttgggggagcaaatccaaacagaagcttctcagacgtgcacaccatggatctggaaaccaggacgtggaccacgccagaagtgaccagccccccaccatccccaagaacaattccaactctctcactctgaaccatgaagctgagaaagaggattcagctgacaaagtaatgagccacagtggtgactcacatgaggaaagccagactgctacactgctctgtttggtgtttggtgggatgaatacagaaggggaaatctatgacgattgtattgtgactgtagtggactaataaaacccacatttttattacctgtcagttactttcagaatagttaagtaaaacattagctgttttatacctccaaaaaaaaaaaaaaaaanaaaaaaaaaaaaaaaaaaacgggggctttttttggggggggggaaaaaggggtttgaaaggggcaggggctagggtttcctggaccccattttttgggcacaagggggaaattgggggggccccaaagggggggggataaatggaaaccggttaccgttgttctgggaaaa

SEQ ID NO: 308318 - DNA, 1237 bp, Homo sapiens
  misc_feature (8)..(8): n is a, c, g, or t
  misc_feature (955)..(956): n is a, c, g, or t
  misc_feature (999)..(999): n is a, c, g, or t
  misc_feature (1006)..(1006): n is a, c, g, or t
  misc_feature (1167)..(1167): n is a, c, g, or t
  misc_feature (1216)..(1216): n is a, c, g, or t
  misc_feature (1227)..(1227): n is a, c, g, or t
agaggcgnagaacttaggctaggtcgggctggggcgagggtccccggataccgggtctatcacagtctcgggcagggagtctgaatcttttaggggagtgggcccaagccgggtgcaaagaacggggaagggccttccctggctccgtcccggccactttgaccgaatcagcctgttctttcccgaccccgtctcctatcccctagaactgccacgtggggatgagatttgctgggctggtagcggcggctgctgcgggaggtcccgcccacgtgaagccagcctaactgagctctggactttggggacagctgtcagtggcctaggccgcaggacaccatgaagcaactgccagtcttggaacctggagacaagcccaggaaagcaacatggaaaacaccagtgggacttagatacctgcaagggcctcttgccccggtatgaacatgctagcttcattccctcctgcacacctgaccgtatctgggtatttggaggtgccaaccaatcaggaaatcgaaattgtctacaagtcctgaatcctgcttttaaatcttggggattttggactgtcttggcaaatcctaagtatcatcttcattcttccttgatgtttaaaccaggacgtggaccacgccagaagtgaccagccccccaccatccccaagaacattccacacatcatcggcagccattggaaaccagctatatgtctttgggggcggagagagaggtgcccagcccgtgcaggacacgaagctgcatgtgtttgacgcaaacactctgacctggtcacagccagagacacttggaaatcctccatctccccggcatggtcatgtgatggtggcagcagggacaaagctcttcatccacggaggcttggcgggggacagattctatgatgacctccactgcattgatataatgcatgaatgcagagctaatccactgnngctgtcagcagctggctgccactagctgggcatggaaacatgngcatctngtggatgactctgagacctgaacatgtcagttacaagagacagatggactgtaaatgtactttaccctgacatgacatcatggtatcatgcctgcgtgtttgaagaatcacttattgactactgaaagtactcatatggcaggctactgacacatctgttngttggaacaagtatgcattgtggctacattctgaccggcccccttcctnataaccccccnacccaaccat

SEQ ID NO: 308319 - DNA, 779 bp, Homo sapiens
  misc_feature (8)..(8): n is a, c, g, or t
agaggcgnagaacttaggctaggtcgggctggggcgagggtccccggataccgggtctatcacagtctcgggcagggagtctgaatcttttaggggagtgggcccaagccgggtgcaaagaacggggaagggccttccctggctccgtcccggccactttgaccgaatcagcctgttctttcccgaccccgtctcctatcccctagaactgccacgtggggatgagatttgctgggctggtagcggcggctgctgcgggaggtcccgcccacgtgaagccagcctaactgagctctggactttggggacagctgtcagtggcctaggccgcaggacaccatgaagcaactgccagtcttggaacctggagacaagcccaggaaagcaacatggtctgtaaggaaggatccagacacagaaaagcatgagtttttgtttcatttataagtagtttatttacatatttgatcatcaacaaaaaggggtagagatgaaactgtctgcagtttctggtaattagactcaaactgtctgagaaagtcttcagaggaaagataggggggcagtaattatcacagagcagatgttaattttattaaaatccatttaccagaaagagtaaggcactgaccatctggcatcctcagctccaatgctgtgtcttcccccgagctctgactcatttttaagatttttaggaaattagatttggattaaactggcttcactgtttcttggctgtttgttcaaacaaccctttattcaacaactaacattgg

SEQ ID NO: 308320 - DNA, 261 bp, Homo sapiens
ccagcctgactccattcttgtgcttacagcttttaaatcttggggattttggactgtcttggcaaatcctaagtatcatcttcattcttccttgatgtttgtgagtatgagatccctgcccaaaactatgctggcccccctggggattggagtttggaaactgacttcactcagccccagagtcaaggtcagaagcccctctacctggatattttaagtgcctgcattctctctggcccagaaaccaggacgtggaccacg

SEQ ID NO: 308321 - DNA, 691 bp, Homo sapiens
aaccaatataataattggcagccccaatctaggaactgggtgaaatgttttccaggaaaacaccagtgggacttagatacctgcaagggcctcttgccccggtatgaacatgctagcttcattccctcctgcacacctgaccgtatctgggtatttggaggtgccaaccaatcaggaaatcgaaattgtctacaagtcctgaatcctggtaagtagccaaaggttattttatttacgtacatacaaataaactttcatgcacacacacacacatatatataaatccaattataattccagtacatttggattatactaattaccatttaactttgctgacatagaaaataggaattttaacttgtagcataatctgaaaacaacagaataaaaacaattgttggtaacacatacaatttttaacttgttaaatgtcaaagctggaagggacttcagagaacagctatatcaagtgggctactcaggtttatcaagggcaaagtgactttcctaaagtcacaagaggccgggcatggtggcccatgcctgtaatcccagtactttgggaggctgaagaaggcagatcacttgaggtcaggagtttgagattggcctggccagcatggtaaaacccccatctctattaaaaatagaaaaattagctgggtgtagtggtgggcgcctataatcc

SEQ ID NO: 308322 - DNA, 2130 bp, Homo sapiens
ggctcttttaaatgaccccaggcgtcgtgtattgaatcctagactcacgtccgtctcgcccggcgcccgagccagtccgcgcgcacgcgcgtctgcgtccccgaaagccccgcccgcaaggcgctgccctgcctacctggtctccgacgtgctcgctggagggcggtgcgaggggccgagccgacaagatgttcttgctgcctcttccggctgcggggcgagtagtcgtccgacgtctggccgtgagacgtttcgggagccggagtctctccaccgcagacatgacgaagggccttgttttaggaatctattccaaagaaaaagaagatgatgtgccacagttcacaagtgcaggagagaattttgataaattgttagctggaaagctgagagagactttgaacatatctggaccacctctgaaggcagggaagactcgaaccttttatggtctgcatcaggacttccccagcgtggtgctagttggcctcggcaaaaaggcagctggaatcgacgaacaggaaaactggcatgaaggcaaagaaaacatcagagctgctgttgcagcggggtgcaggcagattcaagacctggagctctcgtctgtggaggtggatccctgtggagacgctcaggctgctgcggagggagcggtgcttggtctctatgaatacgatgacctaaagcaaaaaaagaagatggctgtgtcggcaaagctctatggaagtggggatcaggaggcctggcagaaaggagtcctgtttgcttctgggcagaacttggcacgccaattgatggagacgccagccaatgagatgacgccaaccagatttgccgaaattattgagaagaatctcaaaagtgctagtagtaaaaccgaggtccatatcagacccaagtcttggattgaggaacaggcaatgggatcattcctcagtgtggccaaaggatctgacgagcccccagtcttcttggaaattcactacaaaggcagccccaatgcaaacgaaccacccctggtgtttgttgggaaaggaattacctttgacagtggtggtatctccatcaaggcttctgcaaatatggacctcatgagggctgacatgggaggagctgcaactatatgctcagccatcgtgtctgctgcaaagcttaatttgcccattaatattataggtctggcccctctttgtgaaaatatgcccagcggcaaggccaacaagccgggggatgttgttagagccaaaaacgggaagaccatccaggttgataacactgatgctgaggggaggctcatactggctgatgcgctctgttacgcacacacgtttaacccgaaggtcatcctcaatgccgccaccttaacaggtgccatggatgtagctttgggatcaggtgccactggggtctttaccaattcatcctggctctggaacaaactcttcgaggccagcattgaaacaggggaccgtgtctggaggatgcctctcttcgaacattatacaagacaggttgtagattgccagcttgctgatgttaacaacattggaaaatacagatctgcaggagcatgtacagctgcagcattcctgaaagaattcgtaactcatcctaagtgggcacatttagacatagcaggcgtgatgaccaacaaagatgaagttccctatctacggaaaggcatgactgggaggcccacaaggactctcattgagttcttacttcgtttcagtcaagacaatgcttagttcagatactcaaaaatgtcttcactctgtcttaaattggacagttgaacttaaaaggtttttgaataaatggatgaaaatcttttaacggagacaaaggatggtatttaaaaatgtagaacacaatgaaatttgtatgccttgatttttttttcatttcacacaaagatttataaaggtaaagttaatatcttacttgataaggatttttaagatactctataaatgattaaaatttttagaacttcctaatcacttttcagagtatatgtttttcattgagaagcaaaattgtaactcagatttgtgatgctaggaacatgagcaaactgaaaattactatgcacttgtcagaaacaataaatgcaacttgttgtgctct

SEQ ID NO: 308323 - DNA, 2283 bp, Homo sapiens
cgcacacgaatgcgggcgcacacgaatgcgggcgcacacgaatgcgggcgcacacgaatgcgggcgcacacgaatgcgggcgcacacgaatgcgggcgcacacgaatgcgggcgcacccttgagtcccctccacaaccgcggtttgatcccagcggtccagtcggccggtgctgcccatccgtcccgccccctagactcacgtccgtctcgcccggcgcccgagccagtccgcgcgcacgcgcgtctgcgtccccgaaagccccgcccgcaaggcgctgccctgcctacctggtctccgacgtgctcgctggagggcggtgcgaggggccgagccgacaagatgttcttgctgcctcttccggctgcggggcgagtagtcgtccgacgtctggccgtgagacgtttcgggagccggagtctctccaccgcagacatgacgaagggccttgttttaggaatctattccaaagaaaaagaagatgatgtgccacagttcacaagtgcaggagagaattttgataaattgttagctggaaagctgagagagactttgaacatatctggaccacctctgaaggcagggaagactcgaaccttttatggtctgcatcaggacttccccagcgtggtgctagttggcctcggcaaaaaggcagctggaatcgacgaacaggaaaactggcatgaaggcaaagaaaacatcagagctgctgttgcagcggggtgcaggcagattcaagacctggagctctcgtctgtggaggtggatccctgtggagacgctcaggctgctgcggagggagcggtgcttggtctctatgaatacgatgacctaaagcaaaaaaagaagatggctgtgtcggcaaagctctatggaagtggggatcaggaggcctggcagaaaggagtcctgtttgcttctgggcagaacttggcacgccaattgatggagacgccagccaatgagatgacgccaaccagatttgccgaaattattgagaagaatctcaaaagtgctagtagtaaaaccgaggtccatatcagacccaagtcttggattgaggaacaggcaatgggatcattcctcagtgtggccaaaggatctgacgagcccccagtcttcttggaaattcactacaaaggcagccccaatgcaaacgaaccacccctggtgtttgttgggaaaggaattacctttgacagtggtggtatctccatcaaggcttctgcaaatatggacctcatgagggctgacatgggaggagctgcaactatatgctcagccatcgtgtctgctgcaaagcttaatttgcccattaatattataggtctggcccctctttgtgaaaatatgcccagcggcaaggccaacaagccgggggatgttgttagagccaaaaacgggaagaccatccaggttgataacactgatgctgaggggaggctcatactggctgatgcgctctgttacgcacacacgtttaacccgaaggtcatcctcaatgccgccaccttaacaggtgccatggatgtagctttgggatcaggtgccactggggtctttaccaattcatcctggctctggaacaaactcttcgaggccagcattgaaacaggggaccgtgtctggaggatgcctctcttcgaacattatacaagacaggttgtagattgccagcttgctgatgttaacaacattggaaaatacagatctgcaggagcatgtacagctgcagcattcctgaaagaattcgtaactcatcctaagtgggcacatttagacatagcaggcgtgatgaccaacaaagatgaagttccctatctacggaaaggcatgactgggaggcccacaaggactctcattgagttcttacttcgtttcagtcaagacaatgcttagttcagatactcaaaaatgtcttcactctgtcttaaattggacagttgaacttaaaaggtttttgaataaatggatgaaaatcttttaacggagacaaaggatggtatttaaaaatgtagaacacaatgaaatttgtatgccttgatttttttttcatttcacacaaagatttataaaggtaaagttaatatcttacttgataaggatttttaagatactctataaatgattaaaatttttagaacttcctaatcacttttcagagtatatgtttttcattgagaagcaaaattgtaactcagatttgtgatgctaggaacatgagcaaactgaaaattactatgcacttgtcagaaacaataaatgcaacttgttgtgctct

SEQ ID NO: 308324 - DNA, 2229 bp, Homo sapiens
cgcacacgaatgcgggcgcacacgaatgcgggcgcacacgaatgcgggcgcacacgaatgcgggcgcacacgaatgcgggcgcacacgaatgcgggcgcacacgaatgcgggcgcacccttgagtcccctccacaaccgcggtttgatcccagcggtccagtcggccggtgctgcccatccgtcccgccccctagactcacgtccgtctcgcccggcgcccgagccagtccgcgcgcacgcgcgtctgcgtccccgaaagccccgcccgcaaggcgctgccctgcctacctggtctccgacgtgctcgctggagggcggtgcgaggggccgagccgacaagatgttcttgctgcctcttccggctgcggggcgagtagtcgtccgacgtctggccgtgagacgtttcgggagccggagtctctccaccgcagacatgacgaagggccttgttttaggaatctattccaaagaaaaagaagatgatgtgccacagttcacaagtgcaggagagaattttgataaattgttagctggaaagctgagagagactttgaacatatctggaccacctctgaaggcagggaagactcgaaccttttatggtctgcatcaggacttccccagcgtggtgctagttggcctcggcaaaaaggcagctggaatcgacgaacaggaaaactggcatgaaggcaaagaaaacatcagagctgctgttgcagcggggtgcaggcagattcaagacctggagctctcgtctgtggaggtggatccctgtggagacgctcaggctgctgcggagggagcggtgcttggtctctatgaatacgatgacctaaagcaaaaaaagaagatggctgtgtcggcaaagctctatggaagtggggatcaggaggcctggcagaaaggagtcctgtttgcttctgggcagaacttggcacgccaattgatggagacgccagccaatgagatgacgccaaccagatttgccgaaattattgagaagaatctcaaaagtgctagtagtaaaaccgaggtccatatcagacccaagtcttggattgaggaacaggcaatgggatcattcctcagtgtggccaaaggatctgacgagcccccagtcttcttggaaattcactacaaaggcagccccaatgcaaacgaaccacccctggtgtttgttgggaaaggaattacctttgacagtggtggtatctccatcaaggcttctgcaaatatggacctcatgagggctgacatgggaggagctgcaactatatgctcagccatcgtgtctgctgcaaagcttaatttgcccattaatattataggtctggcccctctttgtgaaaatatgcccagcggcaaggccaacaagccgggggatgttgttagagccatggctgatgcgctctgttacgcacacacgtttaacccgaaggtcatcctcaatgccgccaccttaacaggtgccatggatgtagctttgggatcaggtgccactggggtctttaccaattcatcctggctctggaacaaactcttcgaggccagcattgaaacaggggaccgtgtctggaggatgcctctcttcgaacattatacaagacaggttgtagattgccagcttgctgatgttaacaacattggaaaatacagatctgcaggagcatgtacagctgcagcattcctgaaagaattcgtaactcatcctaagtgggcacatttagacatagcaggcgtgatgaccaacaaagatgaagttccctatctacggaaaggcatgactgggaggcccacaaggactctcattgagttcttacttcgtttcagtcaagacaatgcttagttcagatactcaaaaatgtcttcactctgtcttaaattggacagttgaacttaaaaggtttttgaataaatggatgaaaatcttttaacggagacaaaggatggtatttaaaaatgtagaacacaatgaaatttgtatgccttgatttttttttcatttcacacaaagatttataaaggtaaagttaatatcttacttgataaggatttttaagatactctataaatgattaaaatttttagaacttcctaatcacttttcagagtatatgtttttcattgagaagcaaaattgtaactcagatttgtgatgctaggaacatgagcaaactgaaaattactatgcacttgtcagaaacaataaatgcaacttgttgtgctct

SEQ ID NO: 308325 - DNA, 2526 bp, Homo sapiens
cgcacacgaatgcgggcgcacacgaatgcgggcgcacacgaatgcgggcgcacacgaatgcgggcgcacacgaatgcgggcgcacacgaatgcgggcgcacacgaatgcgggcgcacccttgagtcccctccacaaccgcggtttgatcccagcggtccagtcggccggtgctgcccatccgtcccgccccctagactcacgtccgtctcgcccggcgcccgagccagtccgcgcgcacgcgcgtctgcgtccccgaaagccccgcccgcaaggcgctgccctgcctacctggtctccgacgtgctcgctggagggcggtgcgaggggccgagccgacaagatgttcttgctgcctcttccggctgcggggcgagtagtcgtccgacgtctggccgtgagacgtttcgggagccggagtctctccaccgcagacatgacgaagggccttgttttaggaatctattccaaagaaaaagaagatgatgtgccacagttcacaagtgcaggagagaattttgataaattgttagctggaaagctgagagagactttgaacatatctggaccacctctgaaggcagggaagactcgaaccttttatggtctgcatcaggacttccccagcgtggtgctagttggcctcggcaaaaaggcagctggaatcgacgaacaggaaaactggcatgaaggcaaagaaaacatcagagctgctgttgcagcggggtgcaggcagattcaagacctggagctctcgtctgtggaggtggatccctgtggagacgctcaggctgctgcggagggagcggtgcttggtctctatgaatacgatgacctaaagcaaaaaaagaagatggctgtgtcggcaaagctctatggaagtggggatcaggaggcctggcagaaaggagtcctgtttgcttctgggcagaacttggcacgccaattgatggagacgccagccaatgagatgacgccaaccagatttgccgaaattattgagaagaatctcaaaagtgctagtagtaaaaccgaggtccatatcagacccaagtcttggattgaggaacaggcaatgggatcattcctcagtgtggccaaaggatctgacgagcccccagtcttcttggaaattcactacaaaggcagccccaatgcaaacgaaccacccctggtgtttgttgggaaaggaattacctttgacagtggtggtatctccatcaaggcttctgcaaatatggacctcatgagggctgacatgggaggagctgcaactatatgctcagccatcgtgtctgctgcaaagcttaatttgcccattaatattataggtctggcccctctttgtgaaaatatgcccagcggcaaggccaacaagccgggggatgttgttagagccaaaaacgggaagaccatccaggttgataacactgatgctgaggggaggctcatactggctgatgcgctctgttacgcacacacgtttaacccgaaggtcatcctcaatgccgccaccttaacaggtgccatggatgtagctttgggatcaggtgccactggggtctttaccaattcatcctggctctggaacaaactcttcgaggccagcattgaaacaggggaccgtgtctggaggatgcctctcttcgaacattatacaagacaggttgtagattgccagcttgctgatgttaacaacattggaaaatacagatctgcaggagcatgtacagctgcagcattcctgaaagaattcgtaactcatcctaagtgggcacatttagacatagcaggcgtgatgaccaacaaagatgaagttccctatctacggaaaggcatgactgggaggcccacaaggactctcattgagttcttacttcgtttcagtcaagacaatgcttagttcagatactcaaaaatgtcttcactctgtcttaaattggacagttgaacttaaaaggtttttgaataaatggatgaaaatcttttaacggagacaaaggatggtatttaaaaatgtagaacacaatgaaatttgtatgccttgatttttttttcatttcacacaaagatttataaaggtaaagttaatatcttacttgataaggatttttaagatactctataaatgattaaaatttttagaacttcctaatcacttttcagagtatatgtttttcattgagaagcaaaattgtaactcagatttgtgatgctaggaacatgagcaaactgaaaattactatgcacttgtcagaaacaataaatgcaacttgttgtgctctaaaaaaaaaaaaaaacaaaagggggggggtataaaaaatccttggggggccaagttaaggttaccagtttttgggagaagggggccttaaggggcgaatataaggaaggtggcggcgtataaaactcggacgggaaatggtaacttgggattgggaggacctattctggggggagcataggccaaccacgagagaaggtcggataaatttaggtgttgggaacgcatggggaatgaggtttaa

SEQ ID NO: 308326 - DNA, 1645 bp, Homo sapiens
ggtggatccctgtggagacgctcaggctgctgcggagggagcgggcttggtctctatgaatacatcagagctgctgttgcagcggggtgcaggcagattcaagacctggagctctcgtctgtggaggtggatccctgtggagacgctcaggctgctgcggagggagcggtgcttggtctctatgaatacgatgacctaaagcaaaaaaagaagatggctgtgtcggcaaagctctatggaagtggggatcaggaggcctggcagaaaggagtcctgtttgcttctgggcagaacttggcacgccaattgatggagacgccagccaatgagatgacgccaaccagatttgccgaaattattgagaagaatctcaaaagtgctagtagtaaaaccgaggtccatatcagacccaagtcttggattgaggaacaggcaatgggatcattcctcagtgtggccaaaggatctgacgagcccccagtcttcttggaaattcactacaaaggcagccccaatgcaaacgaaccacccctggtgtttgttgggaaaggaattacctttgacagtggtggtatctccatcaaggcttctgcaaatatggacctcatgagggctgacatgggaggagctgcaactatatgctcagccatcgtgtctgctgcaaagcttaatttgcccattaatattataggtctggcccctctttgtgaaaatatgcccagcggcaaggccaacaagccgggggatgttgttagagccaaaaacgggaagaccatccaggttgataacactgatgctgaggggaggctcatactggctgatgcgctctgttacgcacacacgtttaacccgaaggtcatcctcaatgccgccaccttaacaggtgccatggatgtagctttgggatcaggtgccactggggtctttaccaattcatcctggctctggaacaaactcttcgaggccagcattgaaacaggggaccgtgtctggaggatgcctctcttcgaacattatacaagacaggttgtagattgccagcttgctgatgttaacaacattggaaaatacagatctgcaggagcatgtacagctgcagcattcctgaaagaattcgtaactcatcctaagtgggcacatttagacatagcaggcgtgatgaccaacaaagatgaagttccctatctacggaaaggcatgactgggaggcccacaaggactctcattgagttcttacttcgtttcagtcaagacaatgcttagttcagatactcaaaaatgtcttcactctgtcttaaattggacagttgaacttaaaaggtttttgaataaatggatgaaaatcttttaacggagacaaaggatggtatttaaaaatgtagaacacaatgaaatttgtatgccttgatttttttttcatttcacacaaagatttataaaggtaaagttaatatcttacttgataaggatttttaagatactctataaatgattaaaatttttagaacttcctaatcacttttcagagtatatgtttttcattgagaagcaaaattgtaactcagatttgtgatgctaggaacatgagcaaactgaaaattactatgcacttgtcagaaacaataaatgcaacttgttgtgctct

SEQ ID NO: 308327 - DNA, 1935 bp, Homo sapiens
tcatcatttccctgtcatttttaatcagagaagctcttggcaattgggaagcttcatcaggaaatcatagtgtttcagaaataatcctaggaataattgccacttcctgagagcctgtacggctctgggaggagctattcattctctccatcagcctgtcctcaccaccacctgggagtgaggtacttgctgtaaaatgcactcacgtcttcattttacagaagaggaaatgaggctcagaacattcgggtatcagggctgggatttgaaccccagggctgttttctcagcacatcacatcatgcctctgctgtctgctctttgagttgtcttggactgactccagttttctgattcctctgtcttttcaagcggggtgcaggcagattcaagacctggagctctcgtctgtggaggtggatccctgtggagacgctcaggctgctgcggagggagcggtgcttggtctctatgaatacgatgacctaaagcaaaaaaagaagatggctgtgtcggcaaagctctatggaagtggggatcaggaggcctggcagaaaggagtcctgtttgcttctgggcagaacttggcacgccaattgatggagacgccagccaatgagatgacgccaaccagatttgccgaaattattgagaagaatctcaaaagtgctagtagtaaaaccgaggtccatatcagacccaagtcttggattgaggaacaggcaatgggatcattcctcagtgtggccaaaggatctgacgagcccccagtcttcttggaaattcactacaaaggcagccccaatgcaaacgaaccacccctggtgtttgttgggaaaggaattacctttgacagtggtggtatctccatcaaggcttctgcaaatatggacctcatgagggctgacatgggaggagctgcaactatatgctcagccatcgtgtctgctgcaaagcttaatttgcccattaatattataggtctggcccctctttgtgaaaatatgcccagcggcaaggccaacaagccgggggatgttgttagagccaaaaacgggaagaccatccaggttgataacactgatgctgaggggaggctcatactggctgatgcgctctgttacgcacacacgtttaacccgaaggtcatcctcaatgccgccaccttaacaggtgccatggatgtagctttgggatcaggtgccactggggtctttaccaattcatcctggctctggaacaaactcttcgaggccagcattgaaacaggggaccgtgtctggaggatgcctctcttcgaacattatacaagacaggttgtagattgccagcttgctgatgttaacaacattggaaaatacagatctgcaggagcatgtacagctgcagcattcctgaaagaattcgtaactcatcctaagtgggcacatttagacatagcaggcgtgatgaccaacaaagatgaagttccctatctacggaaaggcatgactgggaggcccacaaggactctcattgagttcttacttcgtttcagtcaagacaatgcttagttcagatactcaaaaatgtcttcactctgtcttaaattggacagttgaacttaaaaggtttttgaataaatggatgaaaatcttttaacggagacaaaggatggtatttaaaaatgtagaacacaatgaaatttgtatgccttgatttttttttcatttcacacaaagatttataaaggtaaagttaatatcttacttgataaggatttttaagatactctataaatgattaaaatttttagaacttcctaatcacttttcagagtatatgtttttcattgagaagcaaaattgtaactcagatttgtgatgctaggaacatgagcaaactgaaaattactatgcacttgtcagaaacaataaatgcaacttgttgtgctct

SEQ ID NO: 308328 - DNA, 2020 bp, Homo sapiens
cgcacacgaatgcgggcgcacacgaatgcgggcgcacacgaatgcgggcgcacacgaatgcgggcgcacacgaatgcgggcgcacacgaatgcgggcgcacacgaatgcgggcgcacccttgagtcccctccacaaccgcggtttgatcccagcggtccagtcggccggtgctgcccatccgtcccgccccctagactcacgtccgtctcgcccggcgcccgagccagtccgcgcgcacgcgcgtctgcgtccccgaaagccccgcccgcaaggcgctgccctgcctacctggtctccgacgtgctcgctggagggcggtgcgaggggccgagccgacaagatgttcttgctgcctcttccggctgcggggcgagtagtcgtccgacgtctggccgtgagacgtttcgggagccggagtctctccaccgcagacatgacgaagggccttgttttaggaatctattccaaagaaaaagaagatgatgtgccacagttcacaagtgcaggagagaattttgataaattgttagctggaaagctgagagagactttgaacatatctggaccacctctgaaggcagggaagactcgaaccttttatggtctgcatcaggacttccccagcgtggtgctagttggcctcggcaaaaaggcagctggaatcgacgaacaggaaaactggcatgaaggcaaagaaaacatcagagctgctgttgcagcggggtgcaggcagattcaagacctggagctctcgtctgtggaggtggatccctgtggagacgctcaggctgctgcggagggagcggtgcttggtctctatgaatacgatgacctaaagcaaaaaaagaagatggctgtgtcggcaaagctctatggaagtggggatcaggaggcctggcagaaaggagtcctgtttgcttctgggcagaacttggcacgccaattgatggagacgccagccaatgagatgacgccaaccagatttgccgaaattattgagaagaatctcaaaagtgctagtagtaaaaccgaggtccatatcagacccaagtcttggattgaggaacaggcaatgggatcattcctcagtgtggccaaaggatctgacgagcccccagtcttcttggaaattcactacaaaggcagccccaatgcaaacgaaccacccctggtgtttgttgggaaaggaattacctttgacagtggtggtatctccatcaaggcttctgcaaatatggacctcatgagggctgacatgggaggagctgcaactatatgctcagccatcgtgtctgctgcaaagcttaatttgcccattaatattataggtctggcccctctttgtgaaaatatgcccagcggcaaggccaacaagccgggggatgttgttagagccaaaaacgggaagaccatccaggttgataacactgatgctgaggggaggctcatactggctgatgcgctctgttacgcacacacgtttaacccgaaggtcatcctcaatgccgccaccttaacaggtgccatggatgtagctttgggatcaggtgccactggggtctttaccaattcatcctggctctggaacaaactcttcgaggtaggaataatatttgtatatctaaattgtagagatggtgaataaattattctagccttagaaggatagacttcttcaaccctgtgttaaagtgatttttatgccgcaggtttgcctttgaattgaaaatgaaccacagcaatagattgagttcagtggcattgggttttccacaaatgctcctaaaggaggggatgatgccccctgctcccctccggtagcctcagcgtcctgtgaaaatatctcacgaacactgtggtcatagttttagaatccctgaggtagaaatggttttgaagatggctttgtggagcagcgtttgtgactgcgtgtcgtgagtcatataagggagttcaccctgcatcgatgaggatgtcttcagaccgctgtgctctgtgcctccctccatgcccttcaca

SEQ ID NO: 308329 - DNA, 674 bp, Homo sapiens
cttgactcttgttctttggttatagaatgtacttagcaaaaatgtgggatctcagtgcacatttacatggggttgtaaagtgctttttgtctttctcttcagatctgcaggagcatgtacagctgcagcattcctgaaagaattcgtaactcatcctaagtgggcacatttagacatagcaggcgtgatgaccaacaaagatgaagttccctatctacggaaaggcatgactgggaggcccacaaggactctcattgagttcttacttcgtttcagtcaagacaatgcttagttcagatactcaaaaatgtcttcactctgtcttaaattggacagttgaacttaaaaggtttttgaataaatggatgaaaatcttttaacggagacaaaggatggtatttaaaaatgtagaacacaatgaaatttgtatgccttgatttttttttcatttcacacaaagatttataaaggtaaagttaatatcttacttgataaggatttttaagatactctataaatgattaaaatttttagaacttcctaatcacttttcagagtatatgtttttcattgagaagcaaaattgtaactcagatttgtgatgctaggaacatgagcaaactgaaaattactatgcacttgtcagaaacaataaatgcaacttgttgtgctct

SEQ ID NO: 308330 - DNA, 870 bp, Homo sapiens
ggctcttttaaatgaccccaggcgtcgtgtattgaatcctagactcacgtccgtctcgcccggcgcccgagccagtccgcgcgcacgcgcgtctgcgtccccgaaagccccgcccgcaaggcgctgccctgcctacctggtctccgacgtgctcgctggagggcggtgcgaggggccgagccgacaagatgttcttgctgcctcttccggctgcggggcgagtagtcgtccgacgtctggccgtgagacgtttcgggagccggagtctctccaccgcagacatgacgaagggccttgttttaggaatctattccaaagaaaaagaagatgatgtgccacagttcacaagtgcaggagagaattttgataaattgttagctggaaagctgagagagactttgaacatatctggaccacctctgaaggcagggaagactcgaaccttttatggtctgcatcaggacttccccagcgtggtgctagttggcctcggcaaaaaggcagctggaatcgacgaacaggaaaactggcatgaaggcaaagaaaacatcagagctgctgttgcaggttatttcactttttaagtttaaagaatcctgaggatccactctttttgatgacctctctttcccctttttgtccttttaccagttgccaccccttaccacgttcacacagaaataattcatcttaacaaaaattcagttcctcttgctgaatatggttggccttatgataaatacagaaggttagctaatggaattttatttttaatatatctatatctcatttgggtgttttactaccatttgttcgctcttgtcatattagagctgtgtttcccagaacctgtagtgtatagattttttg

SEQ ID NO: 308331 - DNA, 4585 bp, Homo sapiens
attacaggtgtgaccgcgcctgtaatcccggcacggacgcgtgggcagcgatcgatgcggccttcagccgcgggggactaggcaaggaagaaggaaggagagggcagcggggccgcctgcagcaggaggctcggcggggccggcggggcagaggcgagaccgagtatagccagcggctcccagcctcggtggctttgggacagacacgcgaggcgcccgggaggtgccaccacaggtggagatccaagtggaggtgggagcggagctacatcacacgtttattgtgcattgattatgtgccagggaccatgctgccgataaacaccttgcatcatttaattctctgagcctctcctggaaagtatgatgctacccggttccacagacagggaaacaagcccagagagggcgacgaatgcactcaaggacagcagctagtgatgctgatgctgctggtccggggaacacactatgagaacctccggtctaaagtggtgctgccaacacccctaggagggaggagcactgaaacctttgtgagcgagttcccgggccccgacaccgggatccgctggcggcgaagcgacgaggcgctgcgcgtgaacgtgggtggcgtgcggcggcagctgagcgcgcgcgccctggcgcgcttcccgggcacgcggctgggccgcctgcaggccgcggcgtcggaggagcaggcgcggcgcctgtgcgacgactacgacgaggcggcgcgcgaattctacttcgaccggcacccgggcttcttcctgagcctgctgcacttctaccgcactggccacctgcacgtgctcgacgagctgtgcgtcttcgcctttggccaggaggccgactactggggcctaggcgagaacgcgcttgccgcgtgctgccgcgcgcgctacctggagaggcggctgacccagccgcacgcctgggacgaggacagcgacacgccgagcagcgtggacccgtgccccgacgagatctccgacgtgcagcgagaactggcgcgctatggcgcggcgcgctgtggccgcctgcgccgccgcctctggctgaccatggagaacccgggctactcgctgccgagcaagctcttcagctgcgtctccatcagcgtggtgctcgcctccatcgccgccatgtgcatccacagcctgcccgagtaccaggcccgcgaggcggcggccgccgtggctgcggtggccgcgggccgcagcccggaaggcgtgcgcgacgacccggtgctgcgacgcctcgagtacttctgcatcgcctggttcagcttcgaggtgtcgtcgcgcctcctgctggcgcccagtacgcgcaacttcttctgccacccgctcaacctcatcgacattgtgtctgtgctgcccttctatctcacgctgctggctggtgtggcactgggcgaccagggcggcaaggagttcggccacctgggcaaggtggtgcaggtgttccgcctcatgcgcatcttccgcgtactcaagttggcgcgccattccaccgggctgcgctcgctgggagccacgctcaagcacagctaccgtgaggtgggcatcttgctgctgtacctggctgtgggtgtgtcagtgttctctggtgtggcctacacagctgaaaaggaggaggacgtgggctttaacaccatcccagcctgctggtggtggggcacagtgagcatgaccaccgtgggctatggggatgtggtgccagtgacggtggctggcaagctggcagcctcaggctgcatcctagggggcatcctggtggtagcactccccatcaccatcatcttcaacaagttctcccacttctaccggcgccagaaggctctggaggcagccgtgcgcaacagcaaccaccaagagtttgaggacttgctgagcagcattgatggggtgtcggaggcatctctggagacatcccgagaaacctctcaggagggacagtctgcagatctagagagccaggcccccagtgagcctccacaccctcagatgtattaaaaccagggatccgtgaccccctgccatgcccctacagtagagattcctcccctgctaaagttcttcatggtagtgagcctcccaggatcactcatgctgtcctgagaaatgagattcaaaagctgcattccttcctccaaaggcccaggacaggacagtgctaccctagattctgtgagattctgcaagcaactcagaaagctttataaacctgcctccaagccattcatgaagcaggcatgaagccagaggggaggaagttgaaaggatactaatgattcctgagcacctcctgtacatgaaccaggtcatgtttggccttgtgttggagaaagagaattatccccacttcacagatgaggaaaccaaggctaagagatgagcgatgcctctcccagatgtcacaattagaagtggcagagtcaggtttggaatctgggcttgttggtgtgcctggagcaatgctccatcaactccatctttcttctgccctcatgaagtttgcgtgtgttttttggtgattcatggatccccagagttgatccacaagataagaaatccctttcagagccagggaagggtccagacaggagatttggatataggagctctggatctcagctgtggttcctttctaggagcatccaacaggagtcagcaatcaaagatgagtcctggagggaaggaggatgagtcctgggaggaagtaccatagcattgtacttgcctctttagctggtatgcaagatttgctaagcaataatcttccgaccttcctcccagggctgatgtgagagaaagaaaatctgaagggcccctggcctgagatctagacaacctagctgcgccaagacctgctgtgtaaagtggtccaatccctgcccccaagtccagattccagcccctctgtcaaatggtcagaatctgtgacccagaaggcaatgaaagccaaggagagcagaggggtctctaacttaaagccagctcagctctgaaatgttcagagggctgacatatatgaatactggcttctaagaccctcccccaacagtctgaccttggcagttcctttctgcccatcacacagacgtccagccctacattgtccagccctacctagagtacccatccaggcccatgtgtgagagtcctctcccttctggccagctccagccccctcacccttgctgggggcatatctctcatacccacctgctgaatcttctcttcacttgctgagaaagtcagaggaggggatccagtagccctttccacatactgtggctacagcacccagcactgtgctgttgttgtctgactgtggctatctctgtcccatcaccctgagcctcaagatggaagacattgtctgcttgaactctgggcttggtgcagagtaggtatttggtaaatgttgaatagatcaaccaattcctacagcccactgggtgccaagctcagagggggaaaaaaagatagccagagagagacctggacctcaaaaaggtgtgaacaagactgaaaaggaggtccgttcagctccgcctgccctgtccctgcttggttcttgaagtttttacaatatattccttgtaggttcttcactcactcactcaacaaatacccgttggaagagtcttaaactggggcttcatgtgtggcctgcagtcatgtttcggcttagtccaacagtgtttttattatattttaagaatctgaatgcctttgcgtgaggcatgcactctcaggttccccatagtgtctcccccgctgccacccacaaacagacacacatgccgttgtgttatgcccagccactctgatatactggcttctgacttatgggctgcttactagtctcaagagatacagtggtggaaaaatatatccctatactcatgaagcttaccgactagtagggaagatagactctaatgcaataatcacataaatatagcgagctctactaagtacaggtgtgtataatgtatcagggaccatggcccgagaaagtgagaaagctttcctgagcaagtgacaatctaacctgccatccaaatgataaattgctaattaagcaaatgaggttccaggggggagtactccaagcagagagaatggcatgtgtgaaggtgtgtgtcatacacagggcctagtacatagtgggccccctacatacgcatggattctgggtctccagattggaacagaggatggagctaagcagcaaagggcctcccttgaattcaccacacacataccagcccttctgcacactctgctccttacatctaggcccagctgaacccaggttaggggcagatcagaagggctgcgtgtagcacccttatggtcttgcagaacacaccaagaaacccgacggcttccatattttctgaccctacaaacaggtccctaatactgatgtggagaaagctcaagagggaatcatctggcctgagcctaccatgaggctgtttgtggttcctggcagaaaagcaacaactcgctccccttcccatgtatcagtgaaaaccattatgcaaataaagagctggcccccg

SEQ ID NO: 308332 - DNA, 2561 bp, Homo sapiens
cggagttaaggccggggggaggcggcgagtcccgcggcggcggcgacgatggggctgcgtgcaggaggaacgctgggcagggccggcgcgggtcggggggcgcccgaggggcccgggccgagcggcggcgcgcagggcggcagcatccactcgggccgcatcgccgcggtgcacaacgtgccgctgagcgtgctcatccggccgctgccgtccgtgttggaccccgccaaggtgcagagcctcgtggacacgatccgggaggacccagacagcgtgccccccatcgatgtcctctggatcaaaggggcccagggaggtgactacttctactcctttgggggctgccaccgctacgcggcctaccagcaactgcagcgagagaccatccccgccaagcttgtccagtccactctctcagacctaagggtgtacctgggagcatccacaccagacttgcagtagcagcctccttggcacctgctgccaccttcaagagcccagaagacacacctggcctccagcaggctgggccatgcagaagggatagcaggggtgcattctctttgcacctggcgagagggtctgactctgggcacccctctcaccagctacaaggccttggactcactgtacagtgtgggagccccagttcccacctctgtgacaataggatcatggccttacccttgaagcattaccgagaaggagaacagagatgggcttgaagagccacgtgctgccggctccaaattcccaaggacaaggatccctctgcatttttgtctatgtaacctcttatatggactacattcagctgcaaggaaaggaaaaccttgattgcagtggtttaaacaaacagaagattgtttttccacatagcatggattctggagatgggtggctaatggtattggttcaacaactccacgaaggtaggggtcacgtcttggatccttttgccttaatctcagtgctcgttacttcatggtcccaagatggctgctgtatccccaagaatcatgtctgcgttcaaggaaggaggggtggaggaagaggaagggccaaactagctggacccgtcaccttctatcagaaagtaaaacctcgtcagaagtctgtttcctgctctctccctctgcatatcttcacttagatgcccttggcccgagccagctaccattgcacctctagctgcaaacaaagctaagacagcagggaacagaattgtcatggctgaatagaccaatcgtgttccatctactgagactggcacactgcctcctgcaataaaactgggatcccattaccaagagagaaatgcagaattgtgtaccagttagcttttgctgtgtaacaaaccatccccaaacttggcagctagaaacaaaccctgtattttcccacaatcctatgggttggcaatttgggctgggctcaacagggcagttctgctgctcacacctgggatccctcatggagctaaggtcagctgttacctcagctgggcctggatggtctaggatagccttactcacttgcctggcaggtgacaggctgttggctggaattgcttggttctcctccatgtggcctctccagcaggctagctcaggcttattcacatgatggcttcaggattccaaagagagtgagagtagaagctgaaagacttcttgagttcttggcctggaactgggactaggacagtgtcacttctgctaagttcttttggtcagagcaaatcacaaggctttacccagattcaagggatgagaaacagactacatgtcttgatgaggggaaccacaaagagcttgtggccatttttcacctatcacaaataattttggatgggtatttatttggataaaggtatttccctcttccccctttctctctgtctcatggggcctcactctgccaagttggaaggcactaagacattgtcctggccctcagggtctaggggaagaggtgttggggcaggaagtgagtctctccatgggctggacccactgtagtaggagtgcctccttgtctgcactgctggtatggggttaggccaggtaggacattccagaggggcttctgaaaaccaagagtccctggggaaagggaacagagtaaggcaggccttgttctcactgccctctaagggaacttggtcactcggcacttttaagcctcagtttctccagttcaataataaggacaagagcttttcccatgcattctctttccccgggaaagttgactgaggtgaccagtaatagaattgaaaagggagagtgtcttcagtgcaatgtggcatcctggattgggtcttggaacaaaaacaggacattagtgggaaaattggaaatctgaaaaaagtctgaattttagttaatataccaatttcagtctcttggttttgacagatgtaccatggtgatgtaagatgttgaccttggggtaggctgggtgaagggtatacaggaactctttgtactatctctgcaacttctctgtaaatctagtatcattccaaaataaaagtttatttaatttaaaaaaaaaaa

SEQ ID NO: 308333 - DNA, 1658 bp, Homo sapiens
actgagattaaggcaaaaggatccaagacgtgacccctaccttcgtgctcgttacttcattggtcgcctaacgatggctgtcgtgtccaccaatgaagtaacgagcactgagaatcatgtctgcgttcaaggaaggaggggtggaggaagaggaagggccaaactagctggacccgtcaccttctatcagaaagtaaaacctcgtcagaagtctgtttcctgctctctccctctgcatatcttcacttagatgcccttggcccgagccagctaccattgcacctctagctgcaaacaaagctaagacagcagggaacagaattgtcatggctgaatagaccaatcgtgttccatctactgagactggcacactgcctcctgcaataaaactgggatcccattaccaagagagaaatgcagaattgtgtaccagttagcttttgctgtgtaacaaaccatccccaaacttggcagctagaaacaaaccctgtattttcccacaatcctatgggttggcaatttgggctgggctcaacagggcagttctgctgctcacacctgggatccctcatggagctaaggtcagctgttacctcagctgggcctggatggtctaggatagccttactcacttgcctggcaggtgacaggctgttggctggaattgcttggttctcctccatgtggcctctccagcaggctagctcaggcttattcacatgatggcttcaggattccaaagagagtgagagtagaagctgaaagacttcttgagttcttggcctggaactgggactaggacagtgtcacttctgctaagttcttttggtcagagcaaatcacaaggctttacccagattcaagggatgagaaacagactacatgtcttgatgaggggaaccacaaagagcttgtggccatttttcacctatcacaaataattttggatgggtatttatttggataaaggtatttccctcttccccctttctctctgtctcatggggcctcactctgccaagttggaaggcactaagacattgtcctggccctcagggtctaggggaagaggtgttggggcaggaagtgagtctctccatgggctggacccactgtagtaggagtgcctccttgtctgcactgctggtatggggttaggccaggtaggacattccagaggggcttctgaaaaccaagagtccctggggaaagggaacagagtaaggcaggccttgttctcactgccctctaagggaacttggtcactcggcacttttaagcctcagtttctccagttcaataataaggacaagagcttttcccatgcattctctttccccgggaaagttgactgaggtgaccagtaatagaattgaaaagggagagtgtcttcagtgcaatgtggcatcctggattgggtcttggaacaaaaacaggacattagtgggaaaattggaaatctgaaaaaagtctgaattttagttaatataccaatttcagtctcttggttttgacagatgtaccatggtgatgtaagatgttgaccttggggtaggctgggtgaagggtatacaggaactctttgtactatctctgcaacttctctgtaaatctagtatcattccaaaataaaagtttatttaatttaaaaaaaaaaa

SEQ ID NO: 308334 - DNA, 2771 bp, Homo sapiens
cggagttaaggccggggggaggcggcgagtcccgcggcggcggcgacgatggggctgcgtgcaggaggaacgctgggcagggccggcgcgggtcggggggcgcccgaggggcccgggccgagcggcggcgcgcagggcggcagcatccactcgggccgcatcgccgcggtgcacaacgtgccgctgagcgtgctcatccggccgctgccgtccgtgttggaccccgccaaggtgcagagcctcgtggacacgatccgggaggacccagacagcgtgccccccatcgatgtcctctggatcaaaggggcccagggaggtgactacttctactcctttgggggctgccaccgctacgcggcctaccagcaactgcagcgagagaccatccccgccaagcttgtccagtccactctctcagacctaagggtgtacctgggagcatccacaccagacttgcagtagcagcctccttggcacctgctgccaccttcaagagcccagaagacacacctggcctccagcaggctgggccatgcagaagggatagcaggggtgcattctctttgcacctggcgagagggtctgactctgggcacccctctcaccagctacaaggccttggactcactgtacagtgtgggagccccagttcccacctctgtgacaataggatcatggccttacccttgaagcattaccgagaaggagaacagagatgggcttgaagagccacgtgctgccggctccaaattcccaaggacaaggatccctctgcatttttgtctatgtaacctcttatatggactacattcagctgcaaggaaaggaaaaccttgattgcagtggtttaaacaaacagaagattgtttttccacatagcatggattctggagatgggtggctaatggtattggttcaacaactccacgaaggtaggggtcacgtcttggatccttttgccttaatctcagtgctcgttacttcatggtcccaagatggctgctgtatccccaagaatcatgtctgcgttcaaggaaggaggggtggaggaagaggaagggccaaactagctggacccgtcaccttctatcagaaagtaaaacctcgtcagaagtctgtttcctgctctctccctctgcatatcttcacttagatgcccttggcccgagccagctaccattgcacctctagctgcaaacaaagctaagacagcagggaacagaattgtcatggctgaatagaccaatcgtgttccatctactgagactggcacactgcctcctgcaataaaactgggatcccattaccaagagagaaatgcagaattgtgtaccagttagcttttgctgtgtaacaaaccatccccaaacttggcagctagaaacaaaccctgtattttcccacaatcctatgggttggcaatttgggctgggctcaacagggcagttctgctgctcacacctgggatccctcatggagctaaggtcagctgttacctcagctgggcctggatggtctaggatagccttactcacttgcctggcaggtgacaggctgttggctggaattgcttggttctcctccatgtggcctctccagcaggctagctcaggcttattcacatgatggcttcaggattccaaagagagtgagagtagaagctgaaagacttcttgagttcttggcctggaactgggactaggacagtgtcacttctgctaagttcttttggtcagagcaaatcacaaggctttacccagattcaagggatgagaaacagactacatgtcttgatgaggggaaccacaaagagcttgtggccatttttcacctatcacaaataattttggatgggtatttatttggataaaggtatttccctcttccccctttctctctgtctcatggggcctcactctgccaagttggaaggcactaagacattgtcctggccctcagggtctaggggaagaggtgttggggcaggaagtgagtctctccatgggctggacccactgtagtaggagtgcctccttgtctgcactgctggtatggggttaggccaggtaggacattccagaggggcttctgaaaaccaagagtccctggggaaagggaacagagtaaggcaggccttgttctcactgccctctaagggaacttggtcactcggcacttttaagcctcagtttctccagttcaataataaggacaagagcttttcccatgcattctctttccccgggaaagttgactgaggtgaccagtaatagaattgaaaagggagagtgtcttcagtgcaatgtggcatcctggattgggtcttggaacaaaaacaggacattagtgggaaaattggaaatctgaaaaaagtctgaattttagttaatataccaatttcagtctcttggttttgacagatgtaccatggtgatgtaagatgttgaccttggggtaggctgggtgaagggtatacaggaactctttgtactatctctgcaacttctctgtaaatctagtatcattccaaaataaaagtttatttaatttaaaaaaaaaaaaaaaaaaaaaaaaaaatacaaaacaaaaaacaaaaaatcacatagaacaacaaagaacatcaaagaacaacaaaaacacacactggtgtgcggcggcgcgcgctgggcggccgcccgggagaagactttctgcagaaaccccttggggggggggggcggggcccccatgggtatacgagcacgcggggcacagggggccccagaggaacg

SEQ ID NO: 308335 - DNA, 2367 bp, Homo sapiens
  misc_feature (2348)..(2348): n is a, c, g, or t
  misc_feature (2361)..(2361): n is a, c, g, or t
cggagttaaggccggggggaggcggcgagtcccgcggcggcggcgacgatggggctgcgtgcaggaggaacgctgggcagggccggcgcgggtcggggggcgcccgaggggcccgggccgagcggcggcgcgcagggcggcagcatccactcgggccgcatcgccgcggtgcacaacgtgccgctgagcgtgctcatccggccgctgccgtccgtgttggaccccgccaaggtgcagagcctcgtggacacgatccgggaggacccagacagcgtgccccccatcgatgtcctctggatcaaaggggcccagggaggtgactacttctactcctttgggggctgccaccgctacgcggcctaccagcaactgcagcgagagaccatccccgccaagcttgtccagtccactctctcagacctaagggtgtacctgggagcatccacaccagacttgcagtagcagcctccttggcacctgctgccaccttcaagagcccagaagacacacctggcctccagcaggctgggccatgcagaagggatagcaggggtgcattctctttgcacctggcgagagggtctgactctgggcacccctctcaccagctacaaggccttggactcactgtacagtgtgggagccccagttcccacctctgtgacaataggatcatggccttacccttgaagcattaccgagaaggagaacagagatgggcttgaagagccacgtgctgccggctccaaattcccaaggacaaggatccctctgcatttttgtctatgtaacctcttatatggactacattcagctgcaaggaaaggaaaaccttgattgcagtggtttaaacaaacagaagattgtttttccacatagcatggattctggagatgggtggctaatggtattggttcaacaactccacgaaggtaggggtcacgtcttggatccttttgccttaatctcagtgctcgttacttcatggtcccaagatggctgctgtatccccaagaatcatgtctgcgttcaaggaaggaggggtggaggaagaggaagggccaaactagctggacccgtcaccttctatcagaaagtaaaacctcgtcagaagtctgtttcctgctctctccctctgcatatcttcacttagatgcccttggcccgagccagctaccattgcacctctagctgcaaacaaagctaagacagcagggaacagaattgtcatggctgaatagaccaatcgtgttccatctactgagactggcacactgcctcctgcaataaaactgggatcccattaccaagagagaaatgcagaattgtgtaccagttagcttttgctgtgtaacaaaccatccccaaacttggcagctagaaacaaaccctgtattttcccacaatcctatgggttggcaatttgggctgggctcaacagggcagttctgctgctcacacctgggatccctcatggagctaaggtcagctgttacctcagctgggcctggatggtctaggatagccttactcacttgcctggcaggtgacaggctgttggctggaattgcttggttctcctccatgtggcctctccagcaggctagctcaggcttattcacatgatggcttcaggattccaaagagagtgagagtagaagctgaaagacttcttgagttcttggcctggaactgggactaggacagtgtcacttctgctaagttcttttggtcagagcaaatcacaaggctttacccagattcaagggatgagaaacagactacatgtcttgatgaggggaaccacaaagagcttgtggccatttttcacctatcacaaataattttggatgggtatttatttggataaaggtatttccctcttccccctttctctctgtctcatggggcctcactctgccaagttggaaggcactaagacattgtcctggccctcagggtctaggggaagaggtgttggggcaggaagtgagtctctccatgggctggacccactgtagtaggagtgcctccttgtctgcactgctggtatggggttaggccaggtaggacattccagaggggcttctgaaaaccaagagtccctggggaaagggaacagagtaaggcaggccttgttctcactgccctctaagggaacttggtcactcggcacttttaagcctcagtttctccagttcaataataaggacaagagcttttcccatgcattctctttccccgggaaagttgactgaggtgaccagtaatagaattgaaaagggagagtgtcttcagtgcaatgtggcacgttttcgggtgttttttttttttttttttttgggttnggttttcggaganctttcc

SEQ ID NO: 308336 - DNA, 2538 bp, Homo sapiens
cggagttaaggccggggggaggcggcgagtcccgcggcggcggcgacgatggggctgcgtgcaggaggaacgctgggcagggccggcgcgggtcggggggcgcccgaggggcccgggccgagcggcggcgcgcagggcggcagcatccactcgggccgcatcgccgcggtgcacaacgtgccgctgagcgtgctcatccggccgctgccgtccgtgttggaccccgccaaggtgcagagcctcgtggacacgatccgggaggacccagacagcgtgccccccatcgatgtcctctggatcaaaggggcccagggaggtgactacttctactcctttgggggctgccaccgctacgcggcctaccagcaactgcagcgagagaccatccccgccaagcttgtccagtccactctctcagacctaagggtgtacctgggagcatccacaccagacttgcagtagcagcctccttggcacctgctgccaccttcaagagcccagaagacacacctggcctccagcaggctgggccatgcagaagggatagcaggggtgcattctctttgcacctggcgagagggtctgactctgggcacccctctcaccagctacaaggccttggactcactgtacagtgtgggagccccagttcccacctctgtgacaataggatcatggccttacccttgaagcattaccgagaaggagaacagagatgggcttgaagagccacgtgctgccggctccaaattcccaaggacaaggatccctctgcatttttgtctatgtaacctcttatatggactacattcagctgcaaggaaaggaaaaccttgattgcagtggtttaaacaaacagaagattgtttttccacatagcatggattctggagatgggtggctaatggtattggttcaacaactccacgaaggtaggggtcacgtcttggatccttttgccttaatctcagtgctcgttacttcatggtcccaagatggctgctgtatccccaagaatcatgtctgcgttcaaggaaggaggggtggaggaagaggaagggccaaactagctggacccgtcaccttctatcagaaagtaaaacctcgtcagaagtctgtttcctgctctctccctctgcatatcttcacttagatgcccttggcccgagccagctaccattgcacctctagctgcaaacaaagctaagacagcagggaacagaattgtcatggctgaatagaccaatcgtgttccatctactgagactggcacactgcctcctgcaataaaactgggatcccattaccaagagagaaatgcagaattgtgtaccagttagcttttgctgtgtaacaaaccatccccaaacttggcagctagaaacaaaccctgtattttcccacaatcctatgggttggcaatttgggctgggctcaacagggcagttctgctgctcacacctgggatccctcatggagctaaggtcagctgttacctcagctgggcctggatggtctaggatagccttactcacttgcctggcaggtgacaggctgttggctggaattgcttggttctcctccatgtggcctctccagcaggctagctcaggcttattcacatgatggcttcaggattccaaagagagtgagagtagaagctgaaagacttcttgagttcttggcctggaactgggactaggacagtgtcacttctgctaagttcttttggtcagagcaaatcacaaggctttacccagattcaagggatgagaaacagactacatgtcttgatgaggggaaccacaaagagcttgtggccatttttcacctatcacaaataattttggatgggtatttatttggataaaggtatttccctcttccccctttctctctgtctcatggggcctcactctgccaagttggaaggcactaagacattgtcctggccctcagggtctaggggaagaggtgttggggcaggaagtgagtctctccatgggctggacccactgtagtaggagtgcctccttgtctgcactgctggtatggggttaggccaggtaggacattccagaggggcttctgaaaaccaagagtccctggggaaagggaacagagtaaggcaggccttgttctcactgccctctaagggaacttggtcactcggcacttttaagcctcagtttctccagttcaataataaggacaagagcttttcccatgcattctctttccccgggaaagttgactgaggtgaccatgtcttcagtgcaatgtggcatcctggattgggtcttggaacaaaaacaggacattagtgggaaaattggaaatctgaaaaaagtctgaattttagttaatataccaatttcagtctcttggttttgacagatgtaccatggtgatgtaagatgttgaccttggggtaggctgggtgaagggtatacaggaactctttgtactatctctgcaacttctctgtaaatctagtatcattccaaaataaaagtttatttaatttaaaaaaaaaaa

SEQ ID NO: 308337 - DNA, 1513 bp, Homo sapiens
cggagttaaggccggggggaggcggcgagtcccgcggcggcggcgacgatggggctgcgtgcaggaggaacgctgggcagggccggcgcgggtcggggggcgcccgaggggcccgggccgagcggcggcgcgcagggcggcagcatccactcgggccgcatcgccgcggtgcacaacgtgccgctgagcgtgctcatccggccgctgccgtccgtgttggaccccgccaaggtgcagagcctcgtggacacgatccgggaggacccagacagcgtgccccccatcgatgtcctctggatcaaaggggcccagggaggtgactacttctactcctttgggggctgccaccgctacgcggcctaccagcaactgcagcgagagaccatccccgccaagcttgtccagtccactctctcagacctaagggtgtacctgggagcatccacaccagacttgcagtagcagcctccttggcacctgctgccaccttcaagagcccagaagacacacctggcctccagcaggctgggccatgcagaagggatagcaggggtgcattctctttgcacctggcgagagggtctgactctgggcacccctctcaccagctacaaggccttggactcactgtacagtgtgggagccccagttcccacctctgtgacaataggatcatggccttacccttgaagcattaccgagaaggagaacagagatgggcttgaagagccacgtgctgccggctccaaattcccaaggacaaggatccctctgcatttttgtctatgtaacctcttatatggactacattcagctgcaaggaaaggaaaaccttgattgcagtggtttaaacaaacagaagattgtttttccacatagcatggattctggagatgggtggctaatggtattggttcaacaactccacgaaggtaggggtcacgtcttggatccttttgccttaatctcagtgctcgttacttcatggtcccaagatggctgctgtatccccagccaggtaggacattccagaggggcttctgaaaaccaagagtccctggggaaagggaacagagtaaggcaggccttgttctcactgccctctaagggaacttggtcactcggcacttttaagcctcagtttctccagttcaataataaggacaagagcttttcccatgcattctctttccccgggaaagttgactgaggtgaccagtaatagaattgaaaagggagagtgtcttcagtgcaatgtggcatcctggattgggtcttggaacaaaaacaggacattagtgggaaaattggaaatctgaaaaaagtctgaattttagttaatataccaatttcagtctcttggttttgacagatgtaccatggtgatgtaagatgttgaccttggggtaggctgggtgaagggtatacaggaactctttgtactatctctgcaacttctctgtaaatctagtatcattccaaaataaaagtttatttaatttaaaaaaaaaaa

SEQ ID NO: 308338 - DNA, 465 bp, Homo sapiens
gcctgtcttctgagtgctgtcgggctagtcgggcggggcttgtcttcagtggccttgcagggatgttggtttgtcggtggtcgtcgtcctcagtttctccagttcaataataaggacaagagcttttcccatgcattctctttccccgggaaagttgactgaggtgaccagtaatagaattgaaaagggagagtgtcttcagtgcaatgtggcatcctggattgggtcttggaacaaaaacaggacattagtgggaaaattggaaatctgaaaaaagtctgaattttagttaatataccaatttcagtctcttggttttgacagatgtaccatggtgatgtaagatgttgaccttggggtaggctgggtgaagggtatacaggaactctttgtactatctctgcaacttctctgtaaatctagtatcattccaaaataaaagtttatttaatttaaaaaaaaaaa

SEQ ID NO: 308339 - DNA, 1612 bp, Homo sapiens
ccgcccacggggtgcgggtcccaggaggaccagcagagaggagcataggagagcaaaggagatcagtgacccatggcttccccggtggcgcggaacagcccggagccgcctgtgatttgcatacccatggtgcaccacgaaaagataccctcaagatgcttgcactccctctgtgcgcgcatttctgcactgttttagagcatgatgcctcttacacgcatctgtgtgcataaactacatatagggagtgcgtaccacgcaggcatccaacaaccataagtgtgttaagtgttagttctccctgcgaggttcgaagcggaagtcacgaatatactcgggtttctcttcaaagcgcataaatctttcgccttttactaaagatttccgtggagagaaagttgtgagtttttattcaattttttgaggcctcttatttcctgaggctacatttttaagtattaaaagttaggcaactacaaccaaggaacttggtcatttgttatttgtaccaaatgttcacaaacttattcgggcgtggtggtgcctgtttgcaatcccacctattggagaagctggggcgggagagtctcttgactctagaagacggaggttgtagtgatccgagatcgcgccactgccctctagtcagagtggcagagactcctggggcgggagagtctcttgactctagaagacggaggttgtagtgatccgagatcgcgccactgccctctagtcagagtgacagagattcagtgtaaaacaaaaaaaaaaatcagaagtttgcgtgacaccttgttttgagctacatttggggtttattggcttctgcagtgtgcagtaagactggcttctattgtttatttcttgcgtttttgttgcatttcgttgcagatttaagagataaacagtggaaggcgctttcaagtcgtccggtcattaattaagccttattgtggctagaggttcaggggcggtatatcgcgccaaccaaactccttgttctattcccagagacagtagctgttagcggtttggtgtggctcttccagactgatttttttttcccaactcgattgcgaatccaaacacagtttatgtggtgaagagacaaggttccttctcctatggagcttttttcttttgagatggagtctcactttgtcacccaggctggagtgcagtggctcaatctcggctggagtgcagtggcgcgatctcggctcactgcaacctccacctcccgggttcaagcgattctcctcctcagcctcccaagtagctgggactacaggtgcccaccaccatgcccggctaattttgttgccctctttttaatgggattatttgttaagttgtttgagttttcgtgtattttggtattagtcccctgctaaataaatagtttgtagatattttctcccattttacaagttgtctgttcactctgttgattatttcttgggctgtgcagaagcttcttgtttaataattcccatttgcctactttttaaattgcctatgcttttgatgttttagtgacaaattttttgccccgaccaatgcttataagagttatccttagatcttttcttagtatttattgaaatgg

SEQ ID NO: 308340 - DNA, 1202 bp, Homo sapiens
ccggtggggcgggaagcccggcttctggggaggtgccgcccctccactggcgcaggccgccgagacccccagacggacctcctagggctaatctgatagtgcctctgaggtcgataggactccacgtgccactccctgcagggtcatccagcaagtaattcctagacccgtaggtggccgcagagccggttacctctggttctgcgccagcgtgccccacccgcaggacggccgggttctttgatttgtacactttctaaaaccaaacccgagaggaagggcaggctcagggtggggatgccctgaaatattcgagagcaggaccgtttctactgaagagaagtttacaagaacgctctgtctggggcgggcgaggcctctgcgaggcgggtccgggagcgagggcagggcgtgggccgcgcgcccggggtcgggggagtcgggggcaggaagagggggaggagacagggctgggggagcgccctgccgagcgcccgccaggctcctcccgctcccgcaccgcctccctctacccacccgccgcacgtactaaggaaggcgcacagcccgccgcgctcgcctctccgccccgcgtccagctcgcccagctcgcccagcgtccgccgcgcctcggccaaggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaaaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttccaaa

SEQ ID NO: 308341 - DNA, 623 bp, Homo sapiens
agtgagtcacacctggtctggctgccagtctgcaggagaggtttctcgactgaactgccggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaaaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttccaaa

SEQ ID NO: 308342 - DNA, 1333 bp, Homo sapiens
  misc_feature (1234)..(1234): n is a, c, g, or t
  misc_feature (1239)..(1239): n is a, c, g, or t
  misc_feature (1243)..(1243): n is a, c, g, or t
  misc_feature (1245)..(1245): n is a, c, g, or t
ccggtggggcgggaagcccggcttctggggaggtgccgcccctccactggcgcaggccgccgagacccccagacggacctcctagggctaatctgatagtgcctctgaggtcgataggactccacgtgccactccctgcagggtcatccagcaagtaattcctagacccgtaggtggccgcagagccggttacctctggttctgcgccagcgtgccccacccgcaggacggccgggttctttgatttgtacactttctaaaaccaaacccgagaggaagggcaggctcagggtggggatgccctgaaatattcgagagcaggaccgtttctactgaagagaagtttacaagaacgctctgtctggggcgggcgaggcctctgcgaggcgggtccgggagcgagggcagggcgtgggccgcgcgcccggggtcgggggagtcgggggcaggaagagggggaggagacagggctgggggagcgccctgccgagcgcccgccaggctcctcccgctcccgcaccgcctccctctacccacccgccgcacgtactaaggaaggcgcacagcccgccgcgctcgcctctccgccccgcgtccagctcgcccagctcgcccagcgtccgccgcgcctcggccaaggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaaaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttccaaaaaaaaaaaacaaaaacaacacacaacacaacncaccncatnanacatcaaaacacgaacagtgagacaaagacagagcacagcaacagtcgaaaatcaagaagaagcccagcacaccacgcagggaacagc

SEQ ID NO: 308343 - DNA, 379 bp, Homo sapiens
  misc_feature (78)..(78): n is a, c, g, or t
  misc_feature (81)..(81): n is a, c, g, or t
  misc_feature (84)..(84): n is a, c, g, or t
  misc_feature (87)..(87): n is a, c, g, or t
  misc_feature (111)..(111): n is a, c, g, or t
gggggtattaaaaggggttttaacaccccaaacccccaaacttgtggtaaaaaaagggcccaacggataaaaaaaggnggnggnaanaaaaagaaataagggttgaagggnggccacgaaaaatataggagggcagagtttcgcgctcctctcccctagataaaagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttccaaa

SEQ ID NO: 308344 - DNA, 898 bp, Homo sapiens
  misc_feature (809)..(809): n is a, c, g, or t
  misc_feature (842)..(843): n is a, c, g, or t
  misc_feature (871)..(871): n is a, c, g, or t
  misc_feature (881)..(881): n is a, c, g, or t
ccggtggggcgggaagcccggcttctggggaggtgccgcccctccactggcgcaggccgccgagacccccagacggacctcctagggctaatctgatagtgcctctgaggtcgataggactccacgtgccactccctgcagggtcatccagcaagtaattcctagacccgtaggtggccgcagagccggttacctctggttctgcgccagcgtgccccacccgcaggacggccgggttctttgatttgtacactttctaaaaccaaacccgagaggaagggcaggctcagggtggggatgccctgaaatattcgagagcaggaccgtttctactgaagagaagtttacaagaacgctctgtctggggcgggcgaggcctctgcgaggcgggtccgggagcgagggcagggcgtgggccgcgcgcccggggtcgggggagtcgggggcaggaagagggggaggagacagggctgggggagcgccctgccgagcgcccgccaggctcctcccgctcccgcaccgcctccctctacccacccgccgcacgtactaaggaaggcgcacagcccgccgcgctcgcctctccgccccgcgtccagctcgcccagctcgcccagcgtccgccgcgcctcggccaaggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaaaatcaaaaaagaccctntggtttgtggacaaaaataaatgaagggacctnntaccaattgttaaagatggccaaaagtngggcctttcnagaagattttttttttc

SEQ ID NO: 308345 - DNA, 1388 bp, Homo sapiens
ccggtggggcgggaagcccggcttctggggaggtgccgcccctccactggcgcaggccgccgagacccccagacggacctcctagggctaatctgatagtgcctctgaggtcgataggactccacgtgccactccctgcagggtcatccagcaagtaattcctagacccgtaggtggccgcagagccggttacctctggttctgcgccagcgtgccccacccgcaggacggccgggttctttgatttgtacactttctaaaaccaaacccgagaggaagggcaggctcagggtggggatgccctgaaatattcgagagcaggaccgtttctactgaagagaagtttacaagaacgctctgtctggggcgggcgaggcctctgcgaggcgggtccgggagcgagggcagggcgtgggccgcgcgcccggggtcgggggagtcgggggcaggaagagggggaggagacagggctgggggagcgccctgccgagcgcccgccaggctcctcccgctcccgcaccgcctccctctacccacccgccgcacgtactaaggaaggcgcacagcccgccgcgctcgcctctccgccccgcgtccagctcgcccagctcgcccagcgtccgccgcgcctcggccaaggtgagctccgcccggcccacgcgcccctcctgggtagtccccaggcccggacctgctgcccggggaaaaccctgcacccggcttcgcggggcgtccggagcaccgcggggctgggcggggagcggctggtggggaatccgctgctcagtgctccgggccacacccaaacgaggccagcagcgcccctccccggcccgggcgcggccgcccccagacccacgcggaccagaggagggggcacttgttctttaggaggggaccgtggtattggtgcgcctgaacctcttccctcctccctttatgtttgcgttgctttactcccacctttcctactttcccactcgtctctcgggttaccgaatccctcctacacgcccctgccctggctggcgtgtttcttggtgggttccgctcgcaggccgggtctgcatgttcgtagcctgctcccggctgtaccgcccaagtaggcgcgggtaggacgagtaggcagctggggcgtcccttccgtaacccttagtccgtcggccaaacaggcgtttctggtcggggcttcctgttgtctgctcgacggaaagggtcttcctgctgagggagggaggtccacttgttttctttctacagcagtttggctggggtttgtgggagagggccctgtgtgacgtggtttctctactgaaagggttcccttgctgtcttaataagtggaaccagaaagagatggaggaagagcaggcttgatgaaggatctt

SEQ ID NO: 308346 - DNA, 696 bp, Homo sapiens
ccgacaaaccaccgcgggcacacatacggctaggtcgagctggtggaatcggacgaggagcccgccgcgctcgcctctccgccccgcgtccagctcgcccagctcgcccagcgtccgccgcgcctcggccaaggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaaaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttccaaa

SEQ ID NO: 308347 - DNA, 615 bp, Homo sapiens
ctgctagtgatcccggatacaggcaccctgcccgcggtagcgcgcctcggcagcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaaaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttccaaa

SEQ ID NO: 308348 - DNA, 789 bp, Homo sapiens
tttatggtgttgacagcacgagcttgaaggtagcatagcacttgcgaaagatcatcttgacgcagttgtatttctagggcaagctggtcggagagaaggctcaataatgccacctcgcaggcgcaacaccaggtgcagggtggactctttctggatgttgtagtctgagagagtgcggccatcctccagctgtttgccggcaaatatcagacgctgctggtcagctgggataccctccttgtcttgaattttggctttgacagccatttaggtacatggctgtacgtttacatttcacaaattcgctggggataaaggctacttaacaaaggaggacctgagagtactcatggaaaaggagttccctggatttttggaaaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttccaaa

SEQ ID NO: 308349 - DNA, 1385 bp, Homo sapiens
ccggtggggcgggaagcccggcttctggggaggtgccgcccctccactggcgcaggccgccgagacccccagacggacctcctagggctaatctgatagtgcctctgaggtcgataggactccacgtgccactccctgcagggtcatccagcaagtaattcctagacccgtaggtggccgcagagccggttacctctggttctgcgccagcgtgccccacccgcaggacggccgggttctttgatttgtacactttctaaaaccaaacccgagaggaagggcaggctcagggtggggatgccctgaaatattcgagagcaggaccgtttctactgaagagaagtttacaagaacgctctgtctggggcgggcgaggcctctgcgaggcgggtccgggagcgagggcagggcgtgggccgcgcgcccggggtcgggggagtcgggggcaggaagagggggaggagacagggctgggggagcgccctgccgagcgcccgccaggctcctcccgctcccgcaccgcctccctctacccacccgccgcacgtactaaggaaggcgcacagcccgccgcgctcgcctctccgccccgcgtccagctcgcccagctcgcccagcgtccgccgcgcctcggccaaggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaaaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttccaaaaaaaaaaaaaaaacaaaaaaaaaaaaaaaaaaaaaaaaaaaaaacaaaaaaacttcagagggactataatggcgggcgtgcggaaacagcacgtactgaacatgggggactagggccaaaggcaagtccctggacccaagttctatggcccaaagggggaaaactttgcagggtcaccataag

SEQ ID NO: 308350 - DNA, 1590 bp, Homo sapiens
ccggtggggcgggaagcccggcttctggggaggtgccgcccctccactggcgcaggccgccgagacccccagacggacctcctagggctaatctgatagtgcctctgaggtcgataggactccacgtgccactccctgcagggtcatccagcaagtaattcctagacccgtaggtggccgcagagccggttacctctggttctgcgccagcgtgccccacccgcaggacggccgggttctttgatttgtacactttctaaaaccaaacccgagaggaagggcaggctcagggtggggatgccctgaaatattcgagagcaggaccgtttctactgaagagaagtttacaagaacgctctgtctggggcgggcgaggcctctgcgaggcgggtccgggagcgagggcagggcgtgggccgcgcgcccggggtcgggggagtcgggggcaggaagagggggaggagacagggctgggggagcgccctgccgagcgcccgccaggctcctcccgctcccgcaccgcctccctctacccacccgccgcacgtactaaggaaggcgcacagcccgccgcgctcgcctctccgccccgcgtccagctcgcccagctcgcccagcgtccgccgcgcctcggccaaggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaaaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttccaaaaaaaaaaaaaaaacaaaaaaaaaaaaaaaaaaaaaaaaaagaaaaacaaagacaagaaaaacaaaaaaaaaaaaaaaaaaaaaaaaacacggggggggggttaaaagttatccttgggggggccaaagtttagggggtaccaggttttttggtaaaaagggggccccatatgggggggggaataaaaagctaggacagggccgtggtttaaacacggtcggggagggggaaacgggtagtgggatcttgggagggacccttatctctgggggggggcctatgggcaaattacctaggagattaaggtccaaaggtaatataacttttaagtgtttcgtggtacagcggatagtgcgctggatattggtacgagtttgtttgacctgtc

SEQ ID NO: 308351 - DNA, 1356 bp, Homo sapiens
ccggtggggcgggaagcccggcttctggggaggtgccgcccctccactggcgcaggccgccgagacccccagacggacctcctagggctaatctgatagtgcctctgaggtcgataggactccacgtgccactccctgcagggtcatccagcaagtaattcctagacccgtaggtggccgcagagccggttacctctggttctgcgccagcgtgccccacccgcaggacggccgggttctttgatttgtacactttctaaaaccaaacccgagaggaagggcaggctcagggtggggatgccctgaaatattcgagagcaggaccgtttctactgaagagaagtttacaagaacgctctgtctggggcgggcgaggcctctgcgaggcgggtccgggagcgagggcagggcgtgggccgcgcgcccggggtcgggggagtcgggggcaggaagagggggaggagacagggctgggggagcgccctgccgagcgcccgccaggctcctcccgctcccgcaccgcctccctctacccacccgccgcacgtactaaggaaggcgcacagcccgccgcgctcgcctctccgccccgcgtccagctcgcccagctcgcccagcgtccgccgcgcctcggccaaggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaaaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttccaaaaaaaaaaaaaaaaaacaaaaaaacttcagagggactataatggcgggcgtgcggaaacagcacgtactgaacatgggggactagggccaaaggcaagtccctggacccaagttctatggcccaaagggggaaaactttgcagggtcaccataag

SEQ ID NO: 308352 - DNA, 1528 bp, Homo sapiens
ccggtggggcgggaagcccggcttctggggaggtgccgcccctccactggcgcaggccgccgagacccccagacggacctcctagggctaatctgatagtgcctctgaggtcgataggactccacgtgccactccctgcagggtcatccagcaagtaattcctagacccgtaggtggccgcagagccggttacctctggttctgcgccagcgtgccccacccgcaggacggccgggttctttgatttgtacactttctaaaaccaaacccgagaggaagggcaggctcagggtggggatgccctgaaatattcgagagcaggaccgtttctactgaagagaagtttacaagaacgctctgtctggggcgggcgaggcctctgcgaggcgggtccgggagcgagggcagggcgtgggccgcgcgcccggggtcgggggagtcgggggcaggaagagggggaggagacagggctgggggagcgccctgccgagcgcccgccaggctcctcccgctcccgcaccgcctccctctacccacccgccgcacgtactaaggaaggcgcacagcccgccgcgctcgcctctccgccccgcgtccagctcgcccagctcgcccagcgtccgccgcgcctcggccaaggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaaaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttccaaaaaaaaaaaaaaaaaaaaaaaaaaaacacggggggggggttaaaagttatccttgggggggccaaagtttagggggtaccaggttttttggtaaaaagggggccccatatgggggggggaataaaaagctaggacagggccgtggtttaaacacggtcggggagggggaaacgggtagtgggatcttgggagggacccttatctctgggggggggcctatgggcaaattacctaggagattaaggtccaaaggtaatataacttttaagtgtttcgtggtacagcggatagtgcgctggatattggtacgagtttgtttgacctgtc

SEQ ID NO: 308353 - DNA, 1203 bp, Homo sapiens
  misc_feature (1182)..(1182): n is a, c, g, or t
ccggtggggcgggaagcccggcttctggggaggtgccgcccctccactggcgcaggccgccgagacccccagacggacctcctagggctaatctgatagtgcctctgaggtcgataggactccacgtgccactccctgcagggtcatccagcaagtaattcctagacccgtaggtggccgcagagccggttacctctggttctgcgccagcgtgccccacccgcaggacggccgggttctttgatttgtacactttctaaaaccaaacccgagaggaagggcaggctcagggtggggatgccctgaaatattcgagagcaggaccgtttctactgaagagaagtttacaagaacgctctgtctggggcgggcgaggcctctgcgaggcgggtccgggagcgagggcagggcgtgggccgcgcgcccggggtcgggggagtcgggggcaggaagagggggaggagacagggctgggggagcgccctgccgagcgcccgccaggctcctcccgctcccgcaccgcctccctctacccacccgccgcacgtactaaggaaggcgcacagcccgccgcgctcgcctctccgccccgcgtccagctcgcccagctcgcccagcgtccgccgcgcctcggccaaggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaaaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgcccttccagagctngggatacctcaggagtcgacc

SEQ ID NO: 308354 - DNA, 1276 bp, Homo sapiens
ccggtggggcgggaagcccggcttctggggaggtgccgcccctccactggcgcaggccgccgagacccccagacggacctcctagggctaatctgatagtgcctctgaggtcgataggactccacgtgccactccctgcagggtcatccagcaagtaattcctagacccgtaggtggccgcagagccggttacctctggttctgcgccagcgtgccccacccgcaggacggccgggttctttgatttgtacactttctaaaaccaaacccgagaggaagggcaggctcagggtggggatgccctgaaatattcgagagcaggaccgtttctactgaagagaagtttacaagaacgctctgtctggggcgggcgaggcctctgcgaggcgggtccgggagcgagggcagggcgtgggccgcgcgcccggggtcgggggagtcgggggcaggaagagggggaggagacagggctgggggagcgccctgccgagcgcccgccaggctcctcccgctcccgcaccgcctccctctacccacccgccgcacgtactaaggaaggcgcacagcccgccgcgctcgcctctccgccccgcgtccagctcgcccagctcgcccagcgtccgccgcgcctcggccaaggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaaaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctaagtttttgcggggtggtgtggtcccgagaggcggggagagggagggggggggggcgggggagggggggggagaggtgaggagggggaggggtggcgggcgggc

SEQ ID NO: 308355 - DNA, 2061 bp, Homo sapiens
ccggtggggcgggaagcccggcttctggggaggtgccgcccctccactggcgcaggccgccgagacccccagacggacctcctagggctaatctgatagtgcctctgaggtcgataggactccacgtgccactccctgcagggtcatccagcaagtaattcctagacccgtaggtggccgcagagccggttacctctggttctgcgccagcgtgccccacccgcaggacggccgggttctttgatttgtacactttctaaaaccaaacccgagaggaagggcaggctcagggtggggatgccctgaaatattcgagagcaggaccgtttctactgaagagaagtttacaagaacgctctgtctggggcgggcgaggcctctgcgaggcgggtccgggagcgagggcagggcgtgggccgcgcgcccggggtcgggggagtcgggggcaggaagagggggaggagacagggctgggggagcgccctgccgagcgcccgccaggctcctcccgctcccgcaccgcctccctctacccacccgccgcacgtactaaggaaggcgcacagcccgccgcgctcgcctctccgccccgcgtccagctcgcccagctcgcccagcgtccgccgcgcctcggccaaggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaagccatatttctctctctggttgatggcatggaccctacaggaaaaaccacaccttaccgcttctgaccagcatcactacaaaaaggagtgctgaagccaatcaccatgtaagcaagataaaagcaaagggggtcttgcctgcccatctctgttccatacattcttaccaggcactgagagtcatggggagtttaagactccatcccacatactccttttgaaactggtccagtgtacaacatccagtgaagagtataggatggcatagacttaccaactcaaagaatggaaggattctagaaacattatagtccaacctcctcaattcatcgttgatacacaaaggcccactaagctgtgtggttcactcagcatcacgtggctaatatgatatgaagccacactagcttgtcctcagctgtgccaagaatgagagctgccttctccaaacctaaaaccaacccatggcatcattaacacctctttaaaatccataggacagtgatccaaaacttattccctaaatcataaatatcttttcataaggagtttcctttgtaagggatttgaccatgccattaggaataaaattttaataagagaatgtaagtttaaaccataaaatgaggagcttagggtggttcttaggcagaatctaaatatgaaattactgaaatgctcccacaaggcaaaaaaaaaaaaaaatacatttagatgaactccaaaggttgcttatgacctaaaacaagagctcaagtaattgggagatatatacacagttctcagcagtacaaatcaaataagctcctcattgcaacctttgacttctatttcttgcctttgttcttttttttttcagaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttccaaa

SEQ ID NO: 308356 - DNA, 1301 bp, Homo sapiens
gtttacctgagccctttaacaacctcaaataggccatatttctctctctggttgatggcatggaccctacaggaaaaaccacaccttaccgcttctgaccagcatcactacaaaaaggagtgctgaagccaatcaccatgtaagcaagataaaagcaaagggggtcttgcctgcccatctctgttccatacattcttaccaggcactgagagtcatggggagtttaagactccatcccacatactccttttgaaactggtccagtgtacaacatccagtgaagagtataggatggcatagacttaccaactcaaagaatggaaggattctagaaacattatagtccaacctcctcaattcatcgttgatacacaaaggcccactaagctgtgtggttcactcagcatcacgtggctaatatgatatgaagccacactagcttgtcctcagctgtgccaagaatgagagctgccttctccaaacctaaaaccaacccatggcatcattaacacctctttaaaatccataggacagtgatccaaaacttattccctaaatcataaatatcttttcataaggagtttcctttgtaagggatttgaccatgccattaggaataaaattttaataagagaatgtaagtttaaaccataaaatgaggagcttagggtggttcttaggcagaatctaaatatgaaattactgaaatgctcccacaaggcaaaaaaaaaaaaaaatacatttagatgaactccaaaggttgcttatgacctaaaacaagagctcaagtaattgggagatatatacacagttctcagcagtacaaatcaaataagctcctcattgcaacctttgacttctatttcttgcctttgttcttttttttttcagaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttccaaa

SEQ ID NO: 308357 - DNA, 1309 bp, Homo sapiens
ccggtggggcgggaagcccggcttctggggaggtgccgcccctccactggcgcaggccgccgagacccccagacggacctcctagggctaatctgatagtgcctctgaggtcgataggactccacgtgccactccctgcagggtcatccagcaagtaattcctagacccgtaggtggccgcagagccggttacctctggttctgcgccagcgtgccccacccgcaggacggccgggttctttgatttgtacactttctaaaaccaaacccgagaggaagggcaggctcagggtggggatgccctgaaatattcgagagcaggaccgtttctactgaagagaagtttacaagaacgctctgtctggggcgggcgaggcctctgcgaggcgggtccgggagcgagggcagggcgtgggccgcgcgcccggggtcgggggagtcgggggcaggaagagggggaggagacagggctgggggagcgccctgccgagcgcccgccaggctcctcccgctcccgcaccgcctccctctacccacccgccgcacgtactaaggaaggcgcacagcccgccgcgctcgcctctccgccccgcgtccagctcgcccagctcgcccagcgtccgccgcgcctcggccaaggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaagccatatttctctctctggttgatggcatggaccctacaggaaaaaccacaccttaccgcttctgaccagcatcactacaaaaaggagtgctgaagccaatcaccataatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttccaaa

SEQ ID NO: 308358 - DNA, 498 bp, Homo sapiens
agctcggtacccatcaggcgaagactgtggatcaggggaagactgtggatcagcgaagactgtggatcaggcgaagactgtggtggaaaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttccaaa

SEQ ID NO: 308359 - DNA, 1144 bp, Homo sapiens
ccggtggggcgggaagcccggcttctggggaggtgccgcccctccactggcgcaggccgccgagacccccagacggacctcctagggctaatctgatagtgcctctgaggtcgataggactccacgtgccactccctgcagggtcatccagcaagtaattcctagacccgtaggtggccgcagagccggttacctctggttctgcgccagcgtgccccacccgcaggacggccgggttctttgatttgtacactttctaaaaccaaacccgagaggaagggcaggctcagggtggggatgccctgaaatattcgagagcaggaccgtttctactgaagagaagtttacaagaacgctctgtctggggcgggcgaggcctctgcgaggcgggtccgggagcgagggcagggcgtgggccgcgcgcccggggtcgggggagtcgggggcaggaagagggggaggagacagggctgggggagcgccctgccgagcgcccgccaggctcctcccgctcccgcaccgcctccctctacccacccgccgcacgtactaaggaaggcgcacagcccgccgcgctcgcctctccgccccgcgtccagctcgcccagctcgcccagcgtccgccgcgcctcggccaaggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaaaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaatcaataaataaagttcttttttagttccaaa

SEQ ID NO: 308360 - DNA, 1200 bp, Homo sapiens
ccggtggggcgggaagcccggcttctggggaggtgccgcccctccactggcgcaggccgccgagacccccagacggacctcctagggctaatctgatagtgcctctgaggtcgataggactccacgtgccactccctgcagggtcatccagcaagtaattcctagacccgtaggtggccgcagagccggttacctctggttctgcgccagcgtgccccacccgcaggacggccgggttctttgatttgtacactttctaaaaccaaacccgagaggaagggcaggctcagggtggggatgccctgaaatattcgagagcaggaccgtttctactgaagagaagtttacaagaacgctctgtctggggcgggcgaggcctctgcgaggcgggtccgggagcgagggcagggcgtgggccgcgcgcccggggtcgggggagtcgggggcaggaagagggggaggagacagggctgggggagcgccctgccgagcgcccgccaggctcctcccgctcccgcaccgcctccctctacccacccgccgcacgtactaaggaaggcgcacagcccgccgcgctcgcctctccgccccgcgtccagctcgcccagctcgcccagcgtccgccgcgcctcggccaaggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaaaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatcgcgcgtttttcgtgccctcaccgaaccttcccctctttacatcccacctcctccccctcctttccctggctgcgagaaaagttaaataccagataagcttttgatttttgtattgtttgcatccccttgccctcaataaataaagttcttttttagttccaaa

SEQ ID NO: 308361 - DNA, 1894 bp, Homo sapiens
ccggtggggcgggaagcccggcttctggggaggtgccgcccctccactggcgcaggccgccgagacccccagacggacctcctagggctaatctgatagtgcctctgaggtcgataggactccacgtgccactccctgcagggtcatccagcaagtaattcctagacccgtaggtggccgcagagccggttacctctggttctgcgccagcgtgccccacccgcaggacggccgggttctttgatttgtacactttctaaaaccaaacccgagaggaagggcaggctcagggtggggatgccctgaaatattcgagagcaggaccgtttctactgaagagaagtttacaagaacgctctgtctggggcgggcgaggcctctgcgaggcgggtccgggagcgagggcagggcgtgggccgcgcgcccggggtcgggggagtcgggggcaggaagagggggaggagacagggctgggggagcgccctgccgagcgcccgccaggctcctcccgctcccgcaccgcctccctctacccacccgccgcacgtactaaggaaggcgcacagcccgccgcgctcgcctctccgccccgcgtccagctcgcccagctcgcccagcgtccgccgcgcctcggccaaggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaagccatatttctctctctggttgatggcatggaccctacaggaaaaaccacaccttaccgcttctgaccagcatcactacaaaaaggagtgctgaagccaatcaccatgtaagcaagataaaagcaaagggggtcttgcctgcccatctctgttccatacattcttaccaggcactgagagtcatggggagtttaagactccatcccacatactccttttgaaactggtccagtgtacaacatccagtgaagagtataggatggcatagacttaccaactcaaagaatggaaggattctagaaacattatagtccaacctcctcaattcatcgttgatacacaaaggcccactaagctgtgtggttcactcagcatcacgtggctaatatgatatgaagccacactagcttgtcctcagctgtgccaagaatgagagctgccttctccaaacctaaaaccaacccatggcatcattaacacctctttaaaatccataggacagtgatccaaaacttattccctaaatcataaatatcttttcataaggagtttcctttgtaagggatttgaccatgccattaggaataaaattttaataagagaatgtaagtttaaaccataaaatgaggagcttagggtggttcttaggcagaatctaaatatgaaattactgaaatgctcccacaaggcaaaaaaaaaaaaaaatacatttagatgaactccaaaggttgcttatgacctaaaacaagagctcaagtaattgggagatatatacacagttctcagcagtacaaatcaaataagctcctcattgcaacctttgacttctatttcttgcctttgttcttttttttttcagaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagtagacagttcgtctcctgataagagttgtcccaaaggtctgacatcccccatagaaggatttcatgacagatcacgctctcagtccc

SEQ ID NO: 308362 - DNA, 1353 bp, Homo sapiens
ccggtggggcgggaagcccggcttctggggaggtgccgcccctccactggcgcaggccgccgagacccccagacggacctcctagggctaatctgatagtgcctctgaggtcgataggactccacgtgccactccctgcagggtcatccagcaagtaattcctagacccgtaggtggccgcagagccggttacctctggttctgcgccagcgtgccccacccgcaggacggccgggttctttgatttgtacactttctaaaaccaaacccgagaggaagggcaggctcagggtggggatgccctgaaatattcgagagcaggaccgtttctactgaagagaagtttacaagaacgctctgtctggggcgggcgaggcctctgcgaggcgggtccgggagcgagggcagggcgtgggccgcgcgcccggggtcgggggagtcgggggcaggaagagggggaggagacagggctgggggagcgccctgccgagcgcccgccaggctcctcccgctcccgcaccgcctccctctacccacccgccgcacgtactaaggaaggcgcacagcccgccgcgctcgcctctccgccccgcgtccagctcgcccagctcgcccagcgtccgccgcgcctcggccaaggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaagtaagtgttgaaaagcttacaaagaaccagacataaaagtcaatgcttctaggccttggttccttttccttcttgtttccatcccttccctgtggaggtcaccactagtgaataaatgaatgtagtcacctgaaggaatgaatgaatgacctcattcattcatttattaaatagtattgagtacctgctatttgtaagatactgttgaggaaacaaagtaatgaagacacagccccaaccttcaaggagcttacagtctgcaggtgaaataagactgcatacaaataaccacaatatgagctgtttgttggaaaattccatcgggttatctgtgtctgttgtgacgatgttggggacagagttgggagaaagaaagcttttcacaaaagagtagtcaaccagaaaatggctaccttcaggtccaaaaacctggtggtggagatgccacatcctggtcacattccattttgagcaactcgaatctcccttcttaaatctcttcagataaagggattgttttttctttttctaatactacaaaggagcagtgtcagtcatcta

SEQ ID NO: 308363 - DNA, 1033 bp, Homo sapiens
ccggtggggcgggaagcccggcttctggggaggtgccgcccctccactggcgcaggccgccgagacccccagacggacctcctagggctaatctgatagtgcctctgaggtcgataggactccacgtgccactccctgcagggtcatccagcaagtaattcctagacccgtaggtggccgcagagccggttacctctggttctgcgccagcgtgccccacccgcaggacggccgggttctttgatttgtacactttctaaaaccaaacccgagaggaagggcaggctcagggtggggatgccctgaaatattcgagagcaggaccgtttctactgaagagaagtttacaagaacgctctgtctggggcgggcgaggcctctgcgaggcgggtccgggagcgagggcagggcgtgggccgcgcgcccggggtcgggggagtcgggggcaggaagagggggaggagacagggctgggggagcgccctgccgagcgcccgccaggctcctcccgctcccgcaccgcctccctctacccacccgccgcacgtactaaggaaggcgcacagcccgccgcgctcgcctctccgccccgcgtccagctcgcccagctcgcccagcgtccgccgcgcctcggccaaggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaagtaagtgttgaaaagcttacaaagaaccagacataaaagtcaatgcttctaggccttggttccttttccttcttgtttccatcccttccctgtggaggtcaccactagtgaataaatgaatgtagtcacctgaaggaatgaatgaatgacctcattcattcatttattaaatagtattgagtacctgctatttgtaagatactgttgaggatggtccgcacaggggatcctcggagttgcc

SEQ ID NO: 308364 - DNA, 967 bp, Homo sapiens
ccggtggggcgggaagcccggcttctggggaggtgccgcccctccactggcgcaggccgccgagacccccagacggacctcctagggctaatctgatagtgcctctgaggtcgataggactccacgtgccactccctgcagggtcatccagcaagtaattcctagacccgtaggtggccgcagagccggttacctctggttctgcgccagcgtgccccacccgcaggacggccgggttctttgatttgtacactttctaaaaccaaacccgagaggaagggcaggctcagggtggggatgccctgaaatattcgagagcaggaccgtttctactgaagagaagtttacaagaacgctctgtctggggcgggcgaggcctctgcgaggcgggtccgggagcgagggcagggcgtgggccgcgcgcccggggtcgggggagtcgggggcaggaagagggggaggagacagggctgggggagcgccctgccgagcgcccgccaggctcctcccgctcccgcaccgcctccctctacccacccgccgcacgtactaaggaaggcgcacagcccgccgcgctcgcctctccgccccgcgtccagctcgcccagctcgcccagcgtccgccgcgcctcggccaaggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaagttctcgagaggtggctgttgaattcaactgaaggtgcaacattgcatgacaaaatagtagactgaaatgcaagcccttctttccctaccacaattgtagtcacctgaaaagattgtttctgtgcttggtgttgaataatgcattaacctgtaaagggtgagaggagatacggta

SEQ ID NO: 308365 - DNA, 440 bp, Homo sapiens
gtggaggttctctctcttttaggtatgatccccgttgtgcacctgaaactcaggcgatgactttcagtgaaggaaatgacctgtctagggccacataatacctgtttgaaaagccagtaccacactaagtctccactattaagggtgtgatggtgagggtggggtcgtagggagcacaggtatgtgtcagaaagagaaaacatgaggcttgagtgtcctccatttattcactcattcattctacaaaaatggagagcttactttgtgccagggccttatttgggctggttggtggggattcagtaatgggaatacaccaagaacaagacagacgtgctgccagacatactggaactcacggtttagttgggaaagactgacaggaaataattatccatgagatacataattaaaatttggtgttgtgcactgagaaatac

SEQ ID NO: 308366 - DNA, 763 bp, Homo sapiens
ggtgtcactgagccgcgccagctgagccaggtggagccctactttcctctcctgctttctgcctgtgactagcgccgtcccctaccgcccgtcgaccccacttccatgtctggcggacacagctccccggaacctccacgcccatggccactagacagagggagtcttccttcacctcctgcttttccacctggaattgcgacgcgggcgacgagggcgtgggctgcacctgcgaagatgcttccttgtgcaagaagcgcctgtcgggcgcgggattcggggctggcatctgggacgcgggctgaggtgggaggcgggcctgcatctgaagaatacgctcggaggctggcaggttgctgcccccgcctcgcacgaccctcgcttcccacctgtgaaatgcacagaacagggcttcatttatttaacgaatcgtttctgagctcctgctgtgagccaggcttggagcaagcctgggtactgtggatgggagcaggcccctgaaccaggcgggcggggtcttggcgttctcggagctaaacgctgctagaaagacaaacatgatgcacctaactactgtctccgtagattatgaggatgagaggtggaggttctctctcttttaggtatgatccccgttgtgcacctgaaactcaggcgatgactttcagtgaaggaaatgacctgtctagggccacataatacctgtttgaaaagccagtaccacactaagtctccactattaagggtgtgatggtgagggtgg

SEQ ID NO: 308367 - DNA, 784 bp, Homo sapiens
ctccagtgaagagctaatgactggttagaagattgacaaactaaccaaaattttacacactccggttatgtgtgtgaaaggttataaaaggaatggccgggtgcggtggctcacccctgtaatcccagcactttgggaggccgaggcgggtggatcacctgaggtcaggagtttgagaccagcctggccaacatggagaaaccccgcctctactaaaaatacagaaaattagccaggcatggaggcacatgcctgtaatcccagctactcgggaggctgaggtaggagaatcgcttgaatccgggagctggaggttgcagtgagccaagatcgcaccattgcactccagcctgggcaacaagagcgaaactccatctcaaaaaaaaaaaagagattataaaagggatgatgaacatggagctgcatctttttaaacgttgttttttgatgcttcagactcttaatgcttttatataaagctatcaactgtatgttgatcacagtttataagaaagaacaaatcaagattggcaatccttgccgatcttttagaaataccttttctggagaaaaaaaaatccacatgaagtgcaataagcttataaagctaagtagttattaatatttctattaacatgatacaaaggatgatgattgtaagtgtttactgactggcagcttttatttcagtattagcacagcgtcttgccagtgttggaggccatgtattatttcagttcaactggatgaaatgttaaataaactcagaatgaaaataaattct

SEQ ID NO: 308368 - DNA, 223 bp, Homo sapiens
  misc_feature (141)..(141): n is a, c, g, or t
  misc_feature (156)..(156): n is a, c, g, or t
  misc_feature (209)..(209): n is a, c, g, or t
ctccagtgaagagctaatgactggttagaagattgacaaactaaccaaaattttacacactccggttatgtgtgtgaaaggttataaaaggaatggccgggtgcggtggctcacccctgtggtcccgctcctctcagagtnctacccctaccaggnagtgtgtagctccatttcagaatgttgaccatggagaagctgttgtgtttctntggtcttgaaccag

SEQ ID NO: 308369 - DNA, 2973 bp, Homo sapiens
cgcgctccggggacgcgcgaggacgccgtggcgggagaagcgtttccggtggcggcggaggctgcactgagcgggacctgcgagcagcgcgggcggcagcccgggggaagcgtccgggaccatgtctggagaactaccaccaaacattaacatcaaggaacctcgatgggatcaaagcactttcattggacgagccaatcatttcttcactgtaactgaccccaggaacattctgttaaccaacgaacaactcgagagtgcgagaaaaatagtacatgattacaggcaaggaattgttcctcctggtcttacagaaaatgaattgtggagagcaaagtacatctatgattcagcttttcatcctgacactggtgagaagatgattttgataggaagaatgtcagcccaggttcccatgaacatgaccatcacaggttgtatgatgacgttttacaggactacgccggctgtgctgttctggcagtggattaaccagtccttcaatgccgtcgtcaattacaccaacagaagtggagacgcacccctcactgtcaatgagttgggaacagcttacgtttctgcaacaactggtgccgtagcaacagctctaggactcaatgcattgaccaagcatgtctcaccactgataggacgttttgttccctttgctgccgtagctgctgctaattgcattaatattccattaatgaggcaaagggaactcaaagttggcattcccgtcacggatgagaatgggaaccgcttgggggagtcggcgaacgctgcgaaacaagccatcacgcaagttgtcgtgtccaggattctcatggcagcccctggcatggccatccctccattcattatgaacactttggaaaagaaagcctttttgaagaggttcccatggatgagtgcacccattcaagttgggttagttggcttctgtttggtgtttgctacacccctgtgttgtgccctgtttcctcagaaaagttccatgtctgtgacaagcttggaggccgagttgcaagctaagatccaagagagccatcctgaattgcgacgcgtgtacttcaataagggattgtaaagcagggaggaaacctctgcagctcattctgccactgcaaagctggtgtagccatgctggtgagaaaaatcctgttcaacctgggttctcccagttacggaaaccttttaaagatccacattagccttttagaataaagctgctactttaacagagcacctggcgtgggccaagtgcctgatactcccttacactgaatcatgttatgatttatagaaatacctttcctgtagcttttatagtcattgtttttcaaagacgatataccagccctcacccaggttttaaaaaagcactggtaggcatagaataggtgctcagtatatggtcagtaaatgttctattgattatcaatcagtgaaaaaagaaatctgtttaaaatactgaattttcatctcactcccattgcaaatcaaggagatctcagcagtgaactgggaaaatacaaaagctctgggctaatctataaaaacttaccctgaaatattaagggcagtttgcttctagtttggggattgcgctagcccaatgaaggtgatgaagcttttggatttggagggtaaaagctccttcacaccccttccaaaagtcagtcacagaccactgcaacatgccttccctgctggatcattatatacattcagattgtgagtggattgccttggttgacttttaatttattgttttttgttcttataaagatgataatcttaccttgcagttattgactttatattcaattatttacatcaaataatgaaataactgaaatgtacaaatgtcaaattttggaagtatattcaataccaatgctgtatgagtgggctgaatccagttcattgttttttttttggtaagaagtgagactacagttccagctacctacatgtcttttcttgtcatccttatagatctctttggctttcagaaagatacagtgataatgtgtgtatgaatcagtcacaatgaattttacttgaatattgtatgttgcattccacttcatttgaaaataatgaaaccatgtaccactgtttacatcatctgtagtgatttcatagataatatatttaatatgacagattatgtttcaactctgtagatgtttaacgtcatagacagttggccctctgtatccgtgagctctatatctgtgaattcaaccaagtttggatggaaaattttttttttttttttttttttttttgagacggagtctcgctctgtcacccaggctggagtgcagtggcgtagtctcggctcactgcaagctccgcctcctgggttcacgccgttctcctgcctcagcctctctgagaagctgggactacaggcgcccgccaccacgcccggctaatttttttgtatttttagtagagacggggtttcactgtggtctcgatctcctgacctcgtgatccgcccgccttggcctcccaaggtgctgggattacaagcgtgagccaccgcacccggcctgaaaatattttctaaaaagataaaaaatatacataacgatgaaaaataatacaaatttaaaaaccaatacagtataacaactatttacatagtgcttacattgtattaggtgttataagcaatctagagatgatttagcaagtatacaggaggatgtgcctaggttatatgcaaatactgtgccattttatatcaggaacttgagcatctgcagatattggtatcggagggcggtcctggaaccaagcatccacggatactgaggggtgacatttcatgaagtgtagatcattgtattcagagattgtaaatgaaaaaaatatagaaactatttagttttggtagattttttttctgacaatgtgaccagactgaatttcctcataaagaaaaaatggcgtgcc

SEQ ID NO: 308370 - DNA, 3224 bp, Homo sapiens
aaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttgcactgagcgggacctgcgagcagcgcgggcggcagcccgggggaagcgaggcatggtcttgctttgtcacccaggctggagtgcagcggcatgatgatagctcactacagctccaactcttgggctcaagcgatccccacaccccactgccacctcagcctcctgagtagctgcaactataggcgtgcaccaccatgcccggataatccgggaccatgtctggagaactaccaccaaacattaacatcaaggaacctcgatgggatcaaagcactttcattggacgagccaatcatttcttcactgtaactgaccccaggaacattctgttaaccaacgaacaactcgagagtgcgagaaaaatagtacatgattacaggcaaggaattgttcctcctggtcttacagaaaatgaattgtggagagcaaagtacatctatgattcagcttttcatcctgacactggtgagaagatgattttgataggaagaatgtcagcccaggttcccatgaacatgaccatcacaggttgtatgatgacgttttacaggactacgccggctgtgctgttctggcagtggattaaccagtccttcaatgccgtcgtcaattacaccaacagaagtggagacgcacccctcactgtcaatgagttgggaacagcttacgtttctgcaacaactggtgccgtagcaacagctctaggactcaatgcattgaccaagcatgtctcaccactgataggacgttttgttccctttgctgccgtagctgctgctaattgcattaatattccattaatgaggcaaagggaactcaaagttggcattcccgtcacggatgagaatgggaaccgcttgggggagtcggcgaacgctgcgaaacaagccatcacgcaagttgtcgtgtccaggattctcatggcagcccctggcatggccatccctccattcattatgaacactttggaaaagaaagcctttttgaagaggttcccatggatgagtgcacccattcaagttgggttagttggcttctgtttggtgtttgctacacccctgtgttgtgccctgtttcctcagaaaagttccatgtctgtgacaagcttggaggccgagttgcaagctaagatccaagagagccatcctgaattgcgacgcgtgtacttcaataagggattgtaaagcagggaggaaacctctgcagctcattctgccactgcaaagctggtgtagccatgctggtgagaaaaatcctgttcaacctgggttctcccagttacggaaaccttttaaagatccacattagccttttagaataaagctgctactttaacagagcacctggcgtgggccaagtgcctgatactcccttacactgaatcatgttatgatttatagaaatacctttcctgtagcttttatagtcattgtttttcaaagacgatataccagccctcacccaggttttaaaaaagcactggtaggcatagaataggtgctcagtatatggtcagtaaatgttctattgattatcaatcagtgaaaaaagaaatctgtttaaaatactgaattttcatctcactcccattgcaaatcaaggagatctcagcagtgaactgggaaaatacaaaagctctgggctaatctataaaaacttaccctgaaatattaagggcagtttgcttctagtttggggattgcgctagcccaatgaaggtgatgaagcttttggatttggagggtaaaagctccttcacaccccttccaaaagtcagtcacagaccactgcaacatgccttccctgctggatcattatatacattcagattgtgagtggattgccttggttgacttttaatttattgttttttgttcttataaagatgataatcttaccttgcagttattgactttatattcaattatttacatcaaataatgaaataactgaaatgtacaaatgtcaaattttggaagtatattcaataccaatgctgtatgagtgggctgaatccagttcattgttttttttttggtaagaagtgagactacagttccagctacctacatgtcttttcttgtcatccttatagatctctttggctttcagaaagatacagtgataatgtgtgtatgaatcagtcacaatgaattttacttgaatattgtatgttgcattccacttcatttgaaaataatgaaaccatgtaccactgtttacatcatctgtagtgatttcatagataatatatttaatatgacagattatgtttcaactctgtagatgtttaacgtcatagacagttggccctctgtatccgtgagctctatatctgtgaattcaaccaagtttggatggaaaattttttttttttttttttttttttttgagacggagtctcgctctgtcacccaggctggagtgcagtggcgtagtctcggctcactgcaagctccgcctcctgggttcacgccgttctcctgcctcagcctctctgagaagctgggactacaggcgcccgccaccacgcccggctaatttttttgtatttttagtagagacggggtttcactgtggtctcgatctcctgacctcgtgatccgcccgccttggcctcccaaggtgctgggattacaagcgtgagccaccgcacccggcctgaaaatattttctaaaaagataaaaaatatacataacgatgaaaaataatacaaatttaaaaaccaatacagtataacaactatttacatagtgcttacattgtattaggtgttataagcaatctagagatgatttagcaagtatacaggaggatgtgcctaggttatatgcaaatactgtgccattttatatcaggaacttgagcatctgcagatattggtatcggagggcggtcctggaaccaagcatccacggatactgaggggtgacatttcatgaagtgtagatcattgtattcagagattgtaaatgaaaaaaatatagaaactatttagttttggtagattttttttctgacaatgtgaccagactgaatttcctcataaagaaaaaatggcgtgcc

SEQ ID NO: 308371 - DNA, 2925 bp, Homo sapiens
atcccacgtagcccactgactgagctgggactcgagcagcgcgtgtggcagcccgggggaagcgtccgggaccatgtctggagaactaccaccaaacattaacatcaaggaacctcgatgggatcaaagcactttcattggacgagccaatcatttcttcactgtaactgaccccaggaacattctgttaaccaacgaacaactcgagagtgcgagaaaaatagtacatgattacaggcaaggaattgttcctcctggtcttacagaaaatgaattgtggagagcaaagtacatctatgattcagcttttcatcctgacactggtgagaagatgattttgataggaagaatgtcagcccaggttcccatgaacatgaccatcacaggttgtatgatgacgttttacaggactacgccggctgtgctgttctggcagtggattaaccagtccttcaatgccgtcgtcaattacaccaacagaagtggagacgcacccctcactgtcaatgagttgggaacagcttacgtttctgcaacaactggtgccgtagcaacagctctaggactcaatgcattgaccaagcatgtctcaccactgataggacgttttgttccctttgctgccgtagctgctgctaattgcattaatattccattaatgaggcaaagggaactcaaagttggcattcccgtcacggatgagaatgggaaccgcttgggggagtcggcgaacgctgcgaaacaagccatcacgcaagttgtcgtgtccaggattctcatggcagcccctggcatggccatccctccattcattatgaacactttggaaaagaaagcctttttgaagaggttcccatggatgagtgcacccattcaagttgggttagttggcttctgtttggtgtttgctacacccctgtgttgtgccctgtttcctcagaaaagttccatgtctgtgacaagcttggaggccgagttgcaagctaagatccaagagagccatcctgaattgcgacgcgtgtacttcaataagggattgtaaagcagggaggaaacctctgcagctcattctgccactgcaaagctggtgtagccatgctggtgagaaaaatcctgttcaacctgggttctcccagttacggaaaccttttaaagatccacattagccttttagaataaagctgctactttaacagagcacctggcgtgggccaagtgcctgatactcccttacactgaatcatgttatgatttatagaaatacctttcctgtagcttttatagtcattgtttttcaaagacgatataccagccctcacccaggttttaaaaaagcactggtaggcatagaataggtgctcagtatatggtcagtaaatgttctattgattatcaatcagtgaaaaaagaaatctgtttaaaatactgaattttcatctcactcccattgcaaatcaaggagatctcagcagtgaactgggaaaatacaaaagctctgggctaatctataaaaacttaccctgaaatattaagggcagtttgcttctagtttggggattgcgctagcccaatgaaggtgatgaagcttttggatttggagggtaaaagctccttcacaccccttccaaaagtcagtcacagaccactgcaacatgccttccctgctggatcattatatacattcagattgtgagtggattgccttggttgacttttaatttattgttttttgttcttataaagatgataatcttaccttgcagttattgactttatattcaattatttacatcaaataatgaaataactgaaatgtacaaatgtcaaattttggaagtatattcaataccaatgctgtatgagtgggctgaatccagttcattgttttttttttggtaagaagtgagactacagttccagctacctacatgtcttttcttgtcatccttatagatctctttggctttcagaaagatacagtgataatgtgtgtatgaatcagtcacaatgaattttacttgaatattgtatgttgcattccacttcatttgaaaataatgaaaccatgtaccactgtttacatcatctgtagtgatttcatagataatatatttaatatgacagattatgtttcaactctgtagatgtttaacgtcatagacagttggccctctgtatccgtgagctctatatctgtgaattcaaccaagtttggatggaaaattttttttttttttttttttttttttgagacggagtctcgctctgtcacccaggctggagtgcagtggcgtagtctcggctcactgcaagctccgcctcctgggttcacgccgttctcctgcctcagcctctctgagaagctgggactacaggcgcccgccaccacgcccggctaatttttttgtatttttagtagagacggggtttcactgtggtctcgatctcctgacctcgtgatccgcccgccttggcctcccaaggtgctgggattacaagcgtgagccaccgcacccggcctgaaaatattttctaaaaagataaaaaatatacataacgatgaaaaataatacaaatttaaaaaccaatacagtataacaactatttacatagtgcttacattgtattaggtgttataagcaatctagagatgatttagcaagtatacaggaggatgtgcctaggttatatgcaaatactgtgccattttatatcaggaacttgagcatctgcagatattggtatcggagggcggtcctggaaccaagcatccacggatactgaggggtgacatttcatgaagtgtagatcattgtattcagagattgtaaatgaaaaaaatatagaaactatttagttttggtagattttttttctgacaatgtgaccagactgaatttcctcataaagaaaaaatggcgtgcc

SEQ ID NO: 308372 - DNA, 3065 bp, Homo sapiens
aaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttgcactgagcgggacctgcgagcagcgcgggcggcagcccgggggaagcggtgagtcgcgggcggcaggcccagccagtccgggaccatgtctggagaactaccaccaaacattaacatcaaggaacctcgatgggatcaaagcactttcattggacgagccaatcatttcttcactgtaactgaccccaggaacattctgttaaccaacgaacaactcgagagtgcgagaaaaatagtacatgattacagaaaatgaattgtggagagcaaagtacatctatgattcagcttttcatcctgacactggtgagaagatgattttgataggaagaatgtcagcccaggttcccatgaacatgaccatcacaggttgtatgatgacgttttacaggactacgccggctgtgctgttctggcagtggattaaccagtccttcaatgccgtcgtcaattacaccaacagaagtggagacgcacccctcactgtcaatgagttgggaacagcttacgtttctgcaacaactggtgccgtagcaacagctctaggactcaatgcattgaccaagcatgtctcaccactgataggacgttttgttccctttgctgccgtagctgctgctaattgcattaatattccattaatgaggcaaagggaactcaaagttggcattcccgtcacggatgagaatgggaaccgcttgggggagtcggcgaacgctgcgaaacaagccatcacgcaagttgtcgtgtccaggattctcatggcagcccctggcatggccatccctccattcattatgaacactttggaaaagaaagcctttttgaagaggttcccatggatgagtgcacccattcaagttgggttagttggcttctgtttggtgtttgctacacccctgtgttgtgccctgtttcctcagaaaagttccatgtctgtgacaagcttggaggccgagttgcaagctaagatccaagagagccatcctgaattgcgacgcgtgtacttcaataagggattgtaaagcagggaggaaacctctgcagctcattctgccactgcaaagctggtgtagccatgctggtgagaaaaatcctgttcaacctgggttctcccagttacggaaaccttttaaagatccacattagccttttagaataaagctgctactttaacagagcacctggcgtgggccaagtgcctgatactcccttacactgaatcatgttatgatttatagaaatacctttcctgtagcttttatagtcattgtttttcaaagacgatataccagccctcacccaggttttaaaaaagcactggtaggcatagaataggtgctcagtatatggtcagtaaatgttctattgattatcaatcagtgaaaaaagaaatctgtttaaaatactgaattttcatctcactcccattgcaaatcaaggagatctcagcagtgaactgggaaaatacaaaagctctgggctaatctataaaaacttaccctgaaatattaagggcagtttgcttctagtttggggattgcgctagcccaatgaaggtgatgaagcttttggatttggagggtaaaagctccttcacaccccttccaaaagtcagtcacagaccactgcaacatgccttccctgctggatcattatatacattcagattgtgagtggattgccttggttgacttttaatttattgttttttgttcttataaagatgataatcttaccttgcagttattgactttatattcaattatttacatcaaataatgaaataactgaaatgtacaaatgtcaaattttggaagtatattcaataccaatgctgtatgagtgggctgaatccagttcattgttttttttttggtaagaagtgagactacagttccagctacctacatgtcttttcttgtcatccttatagatctctttggctttcagaaagatacagtgataatgtgtgtatgaatcagtcacaatgaattttacttgaatattgtatgttgcattccacttcatttgaaaataatgaaaccatgtaccactgtttacatcatctgtagtgatttcatagataatatatttaatatgacagattatgtttcaactctgtagatgtttaacgtcatagacagttggccctctgtatccgtgagctctatatctgtgaattcaaccaagtttggatggaaaattttttttttttttttttttttttttgagacggagtctcgctctgtcacccaggctggagtgcagtggcgtagtctcggctcactgcaagctccgcctcctgggttcacgccgttctcctgcctcagcctctctgagaagctgggactacaggcgcccgccaccacgcccggctaatttttttgtatttttagtagagacggggtttcactgtggtctcgatctcctgacctcgtgatccgcccgccttggcctcccaaggtgctgggattacaagcgtgagccaccgcacccggcctgaaaatattttctaaaaagataaaaaatatacataacgatgaaaaataatacaaatttaaaaaccaatacagtataacaactatttacatagtgcttacattgtattaggtgttataagcaatctagagatgatttagcaagtatacaggaggatgtgcctaggttatatgcaaatactgtgccattttatatcaggaacttgagcatctgcagatattggtatcggagggcggtcctggaaccaagcatccacggatactgaggggtgacatttcatgaagtgtagatcattgtattcagagattgtaaatgaaaaaaatatagaaactatttagttttggtagattttttttctgacaatgtgaccagactgaatttcctcataaagaaaaaatggcgtgcc

SEQ ID NO: 308373 - DNA, 3106 bp, Homo sapiens
cgcgctccggggacgcgcgaggacgccgtggcgggagaagcgtttccggtggcggcggaggctgcactgagcgggacctgcgagcagcgcgggcggcagcccgggggaagcgtccgggaccatgtctggagaactaccaccaaacattaacatcaaggaacctcgatgggatcaaagcactttcattggacgagccaatcatttcttcactgtaactgaccccaggaacattctgttaaccaacgaacaactcgagagtgcgagaaaaatagtacatgattacaggcaaggaattgttcctcctggtcttacagaaaatgaattgtggagagcaaagtacatctatgattcagcttttcatcctgacactggtgagaagatgattttgataggaagaatgtcagcccaggttcccatgaacatgaccatcacaggttgtatgatgacgttttacaggactacgccggctgtgctgttctggcagtggattaaccagtccttcaatgccgtcgtcaattacaccaacagaagtggagacgcacccctcactgtcaatgagttgggaacagcttacgtttctgcaacaactggtgccgtagcaacagctctaggactcaatgcattgaccaagcatgtctcaccactgataggacgttttgttccctttgctgccgtagctgctgctaattgcattaatattccattaatgaggcaaagggaactcaaagttggcattcccgtcacggatgagaatgggaaccgcttgggggagtcggcgaacgctgcgaaacaagccatcacgcaagttgtcgtgtccaggattctcatggcagcccctggcatggccatccctccattcattatgaacactttggaaaagaaagcctttttgaagaggttcccatggatgagtgcacccattcaagttgggttagttggcttctgtttggtgtttgctacacccctgtgttgtgccctgtttcctcagaaaagttccatgtctgtgacaagcttggaggccgagttgcaagctaagatccaagagagccatcctgaattgcgacgcgtgtacttcaataagggattgtaaagcagggaggaaacctctgcagctcattctgccactgcaaagctggtgtagccatgctggtgagaaaaatcctgttcaacctgggttctcccagttacggaaaccttttaaagatccacattagccttttagaataaagctgctactttaacagagcacctggcgtgggccaagtgcctgatactcccttacactgaatcatgttatgatttatagaaatacctttcctgtagcttttatagtcattgtttttcaaagacgatataccagccctcacccaggttttaaaaaagcactggtaggcatagaataggtgctcagtatatggtcagtaaatgttctattgattatcaatcagtgaaaaaagaaatctgtttaaaatactgaattttcatctcactcccattgcaaatcaaggagatctcagcagtgaactgggaaaatacaaaagctctgggctaatctataaaaacttaccctgaaatattaagggcagtttgcttctagtttggggattgcgctagcccaatgaaggtgatgaagcttttggatttggagggtaaaagctccttcacaccccttccaaaagtcagtcacagaccactgcaacatgccttccctgctggatcattatatacattcagattgtgagtggattgccttggttgacttttaatttattgttttttgttcttataaagatgataatcttaccttgcagttattgactttatattcaattatttacatcaaataatgaaataactgaaatgtacaaatgtcaaattttggaagtatattcaataccaatgctgtatgagtgggctgaatccagttcattgttttttttttggtaagaagtgagactacagttccagctacctacatgtcttttcttgtcatccttatagatctctttggctttcagaaagatacagtgataatgtgtgtatgaatcagtcacaatgaattttacttgaatattgtatgttgcattccacttcatttgaaaataatgaaaccatgtaccactgtttacatcatctgtagtgatttcatagataatatatttaatatgacagattatgtttcaactctgtagatgtttaacgtcatagacagttggccctctgtatccgtgagctctatatctgtgaattcaaccaagtttggatggaaaattttttttttttttttttttttttttgagacggagtctcgctctgtcacccaggctggagtgcagtggcgtagtctcggctcactgcaagctccgcctcctgggttcacgccgttctcctgcctcagcctctctgagaagctgggactacaggcgcccgccaccacgcccgaatcccagcactttgggaggccgaggcgggtggatcacctgaggtcaggagtttgagaccagcctggccaacatggagaaaccccgcctctactaaaaatacagaaaattagccaggcatggaggcacatgcctgtaatcccagctactcgggaggctgaggtaggagaatcgcttgaatccgggagctggaggttgcagtgagccaagatcgcaccattgcactccagcctgggcaacaagagcgaaactccatctcaaaaaaaaaaaagagattataaaagggatgatgaacatggagctgcatctttttaaacgttgttttttgatgcttcagactcttaatgcttttatataaagctatcaactgtatgttgatcacagtttataagaaagaacaaatcaagattggcaatccttgccgatcttttagaaataccttttctggagaaaaaaaaatccacatgaagtgcaataagcttataaagctaagtagttattaatatttctattaacatgatacaaaggatgatgattgtaagtgtttactgactggcagcttttatttcagtattagcacagcgtcttgccagtgttggaggccatgtattatttcagttcaactggatgaaatgttaaataaactcagaatgaaaataaattct

SEQ ID NO: 308374 - DNA, 2126 bp, Homo sapiens
cgcgctccggggacgcgcgaggacgccgtggcgggagaagcgtttccggtggcggcggaggctgcactgagcgggacctgcgagcagcgcgggcggcagcccgggggaagcgtccgggaccatgtctggagaactaccaccaaacattaacatcaaggaacctcgatgggatcaaagcactttcattggacgagccaatcatttcttcactgtaactgaccccaggaacattctgttaaccaacgaacaactcgagagtgcgagaaaaatagtacatgattacaggcaaggaattgttcctcctggtcttacagaaaatgaattgtggagagcaaagtacatctatgattcagcttttcatcctgacactggtgagaagatgattttgataggaagaatgtcagcccaggttcccatgaacatgaccatcacaggttgtatgatgacgttttacaggactacgccggctgtgctgttctggcagtggattaaccagtccttcaatgccgtcgtcaattacaccaacagaagtggagacgcacccctcactgtcaatgagttgggaacagcttacgtttctgcaacaactggtgccgtagcaacagctctaggactcaatgcattgaccaagcatgtctcaccactgataggacgttttgttccctttgctgccgtagctgctgctaattgcattaatattccattaatgaggcaaagggaactcaaagttggcattcccgtcacggatgagaatgggaaccgcttgggggagtcggcgaacgctgcgaaacaagccatcacgcaagttgtcgtgtccaggattctcatggcagcccctggcatggccatccctccattcattatgaacactttggaaaagaaagcctttttgaagaggttcccatggatgagtgcacccattcaagttgggttagttggcttctgtttggtgtttgctacacccctgtgttgtgccctgtttcctcagaaaagttccatgtctgtgacaagcttggaggccgagttgcaagctaagatccaagagagccatcctgaattgcgacgcgtgtacttcaataagggattgtaaagcagggaggaaacctctgcagctcattctgccactgcaaagctggtgtagccatgctggtgagaaaaatcctgttcaacctgggttctcccagttacggaaaccttttaaagatccacattagccttttagaataaagctgctactttaacagagcacctggcgtgggccaagtgcctgatactcccttacactgaatcatgttatgatttatagaaatacctttcctgtagcttttatagtcattgtttttcaaagacgatataccagccctcacccaggttttaaaaaagcactggtaggcatagaataggtgctcagtatatggtcagtaaatgttctattgattatcaatcagtgaaaaaagaaatctgtttaaaatactgaattttcatctcactcccattgcaaatcaaggagatctcagcagtgaactgggaaaatacaaaagctctgggctaatctataaaaacttaccctgaaatattaagggcagtttgcttctagtttggggattgcgctagcccaatgaaggtgatgaagcttttggatttggagggtaaaagctccttcacaccccttccaaaagtcagtcacagaccactgcaacatgccttccctgctggatcattatatacattcagattgtgagtggattgccttggttgacttttaatttattgttttttgttcttataaagatgataatcttaccttgcagttattgactttatattcaattatttacatcaaataatgaaataactgaaatgtacaaatgtcaaattttggaagtatattcaataccaatgctgtatgagtgggctgaatccagttcattgttttttttttggtaagaagtgagactacagttccagctacctacatgtcttttcttgtcatccttatagatctctttggctttcagaaagatacagtgataatgtgtgtatgaatcagtcacaatgaattttacttgaatattgtatgttgcattccacttcatttgaaaataatgaaaccatgtaccactgtt

SEQ ID NO: 308375 - DNA, 2191 bp, Homo sapiens
cgcgctccggggacgcgcgaggacgccgtggcgggagaagcgtttccggtggcggcggaggctgcactgagcgggacctgcgagcagcgcgggcggcagcccgggggaagcgtccgggaccatgtctggagaactaccaccaaacattaacatcaaggaacctcgatgggatcaaagcactttcattggacgagccaatcatttcttcactgtaactgaccccaggaacattctgttaaccaacgaacaactcgagagtgcgagaaaaatagtacatgattacaggcaaggaattgttcctcctggtcttacagaaaatgaattgtggagagcaaagtacatctatgattcagcttttcatcctgacactggtgagaagatgattttgataggaagaatgtcagcccaggttcccatgaacatgaccatcacaggttgtatgatgacgttttacaggactacgccggctgtgctgttctggcagtggattaaccagtccttcaatgccgtcgtcaattacaccaacagaagtggagacgcacccctcactgtcaatgagttgggaacagcttacgtttctgcaacaactggtgccgtagcaacagctctaggactcaatgcattgaccaagcatgtctcaccactgataggacgttttgttccctttgctgccgtagctgctgctaattgcattaatattccattaatgaggcaaagggaactcaaagttggcattcccgtcacggatgagaatgggaaccgcttgggggagtcggcgaacgctgcgaaacaagccatcacgcaagttgtcgtgtccaggattctcatggcagcccctggcatggccatccctccattcattatgaacactttggaaaagaaagcctttttgaagaggttcccatggatgagtgcacccattcaagttgggttagttggcttctgtttggtgtttgctacacccctgtgttgtgccctgtttcctcagaaaagttccatgtctgtgacaagcttggaggccgagttgcaagctaagatccaagagagccatcctgaattgcgacgcgtgtacttcaataagggattgtaaagcagggaggaaacctctgcagctcattctgccactgcaaagctggtgtagccatgctggtgagaaaaatcctgttcaacctgggttctcccagttacggaaaccttttaaagatccacattagccttttagaataaagctgctactttaacagagcacctggcgtgggccaagtgcctgatactcccttacactgaatcatgttatgatttatagaaatacctttcctgtagcttttatagtcattgtttttcaaagacgatataccagccctcacccaggttttaaaaaagcactggtaggcatagaataggtgctcagtatatggtcagtaaatgttctattgattatcaatcagtgaaaaaagaaatctgtttaaaatactgaattttcatctcactcccattgcaaatcaaggagatctcagcagtgaactgggaaaatacaaaagctctgggctaatctataaaaacttaccctgaaatattaagggcagtttgcttctagtttggggattgcgctagcccaatgaaggtgatgaagcttttggatttggagggtaaaagctccttcacaccccttccaaaagtcagtcacagaccactgcaacatgccttccctgctggatcattatatacattcagattgtgagtggattgccttggttgacttttaatttattgttttttgttcttataaagatgataatcttaccttgcagttattgactttatattcaattatttacatcaaataatgaaataactgaaatgtacaaatgtcaaattttggaagtatattcaataccaatgctgtatgagtgggctgaatccagttcattgttttttttttggtaagaagtgagactacagttccaagcctgggcaaccacaagcgagatccatctcaacaaccacacaaaacgcattttctcaccgggacagacgacacagtgcacccagcactctctataccccgatgtactaagcactcctcacaactctataacgcgcttacacatacacgctaccaaccggtcatgtctcacacaacagaataagaatagagaaactcactcatgggaaccttgaccgattttaa

SEQ ID NO: 308376 - DNA, 4108 bp, Homo sapiens
aaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttgcactgagcgggacctgcgagcagcgcgggcggcagcccgggggaagcggtgagtcgcgggcggcaggcccagccagtccgggaccatgtctggagaactaccaccaaacattaacatcaaggaacctcgatgggatcaaagcactttcattggacgagccaatcatttcttcactgtaactgaccccaggaacattctgttaaccaacgaacaactcgagagtgcgagaaaaatagtacatgattacagaaaatgaattgtggagagcaaagtacatctatgattcagcttttcatcctgacactggtgagaagatgattttgataggaagaatgtcagcccaggttcccatgaacatgaccatcacaggttgtatgatgacgttttacaggactacgccggctgtgctgttctggcagtggattaaccagtccttcaatgccgtcgtcaattacaccaacagaagtggagacgcacccctcactgtcaatgagttgggaacagcttacgtttctgcaacaactggtgccgtagcaacagctctaggactcaatgcattgaccaagcatgtctcaccactgataggacgttttgttccctttgctgccgtagctgctgctaattgcattaatattccattaatgaggcaaagggaactcaaagttggcattcccgtcacggatgagaatgggaaccgcttgggggagtcggcgaacgctgcgaaacaagccatcacgcaagttgtcgtgtccaggattctcatggcagcccctggcatggccatccctccattcattatgaacactttggaaaagaaagcctttttgaagaggttcccatggatgagtgcacccattcaagttgggttagttggcttctgtttggtgtttgctacacccctgtgttgtgccctgtttcctcagaaaaggtatgtatttgttattcgtcagaatcatcatgagtattaatcctaaaaaccaattgaaggtgcaggtgccattattccatttcattggcagggaagttgagactcaaaagatactgaagccagggtctcttaaaaggaagggatggaggcagaaatcaaacccacatctgtctaatttcagatgcacccagctcttttctacccccttccattaaatttgaaaatgctttattcttttgtgagaatcagattaactctgatgcaaatttgcttttatgaaaatttaaaatatggtccaatccactggcaaatgcatctgtaatacagatatgataggatgcaagttccacccccagggacagcaattatatgcacttagcttaggtggttggtatatttgcttcctttcttcccacttagttttttgccttaaaagctttcttgtgcacgcctctcatcgcaaactgcccttgaatcctgcctttgatgtgagaacaggactaactggcgttaaatcggcattttctacatcaggtctccagcctgctcttgacctgactccaacacacaaagcagcggcattttgttgtctgtcattttctgtaagtgttaccaggccccttgccttggtaataccctttcctttgtgggccagtaggtcccgaacatatggtctttaatcccccagccttgcggagttggttttggatgaggtgttctgttctagaactaatgctgtcagatccctctacctgatcgagaactccaccttgtatctgctctcccactctgtctccgaccctgctgttcttgaatagaaatttaaacctcatggacaggagcccttcatcaccttggagcctactgaagagccccccttgaagagggcaggaccttcagaacttgctctgggagcctgattcagatgaatttcctcatctctacagtgggataatgatacctgcttaattgtacaaaccccagagtcttggggctcaacctgagaatgtccatttctgtagtatgtggcttatgaacactggtgttcagcagctggccttgatttagcagtttagactttgagcacataaaatgccaaggggtgtgcctgataccaagttgtaaaacacctaagaaatgtagctgtaattattttcagattgaaagggttttagatttgaaaacccatagagaaactttctactttggccttttttctttgagtgctgcaagaaataaaatatagcccaacatttattttttatgattcattgaaactctaggggtagaaatggaaagctttctgtaactactagtgtccttaggtcaaggccctcagaaagcgtgtggttttacatttgagaaaccaatcctcttttgttttactgtattttaaaatagcttcttactctgttttgttgtttatacattgtatgtttggcttcttgaggtctctggctcctcagtttttccttggctcataacatagtatcctcattgatccaagcatgaccctgttttgcttatttttattttacttatactaataatataatgaatatccacaaattcagtgcccaatgaggcaggagaatcgctcgaacccagtaggcagaggctgtggtgagccaagatcacgctactgcattccagcctgggcaacagtgcgagattctgtctcaaaaaaaaaaaaaaaaaaaatatatatatatatatatatatatatatctccaataagttacatcttataggctcctcccaacctgtgtccctgcctcccctgcagatttaaccactatgctgaatttcatgctcttgcattttatatttgtgtatgtatctttagtttgtcttaggaactttttagacaagggtgtcacactgtcataagatgtatagtcttctagtacttgttctttttattcagtgtcagaactaagattcatctacattattgtgtgtacctatagtccattcattgttgttgttgtataatagtgcattgtatgaatgcaccacagtttcccgtctcctatgtgaacaagtgataatgaaaacattctttattaacatttttgagaagcagcaaatgtgttgctttgagagatatttatagctttaaatgtttatattatgaagaatagctgaaaatcaatgcactaaatgtcccaacttaaaaaaaaaaaagcacaaaagaataaacatcagaaaagaaggaaggaaggagatgaagatcagaaatcaataaaataaataacagaaagagtagaggatcaacaaagtgaaatcttggttctttgaaaatagaaacaaaatagacagttgtctggtgagattaatcaaaacaaaaagagaaagagaaaagtacaaataatatgaatgaaaaagaggtataactgtaggttcagcagtgattaaaaataataccaacattataccaacagatttgaaaacaagcaaaatagacaaatttctggaaaaaatattagcaaagctgaaaaattagaaagtcagaataggccagatagtcattaaggaagctgaagcagcatttaatcttcctcctacaaagaaaacacaagaaacaggtagttttacaggtaagtttctcccaactgtcaagaaacagattattccaatttcaaacaaactctcctggaagataaaaaagagaatactccccatcatccaccaaggtttgaataactttaattccaagatcagacttgggcctttaacatacattcatagtaattacagatacttagagatcagtggcaaaacagaaagaccaagaggtggtatagcagggctttgggatcaagaaagatctgccttcaacatctcagttgcacctcaggtttccttacctgtacaattataatactggacttacagagttttcctaagggttaaaatgcataacgtctggcccagcaagtgagctgtaagtcatagccattatcattaccatcatcagtgtcgtcatcatcatttaaaatcacccaaagaccccccccata

SEQ ID NO: 308377 - DNA, 989 bp, Homo sapiens
cgcgctccggggacgcgcgaggacgccgtggcgggagaagcgtttccggtggcggcggaggctgcactgagcgggacctgcgagcagcgcgggcggcagcccgggggaagcgtccgggaccatgtctggagaactaccaccaaacattaacatcaaggaacctcgatgggatcaaagcactttcattggacgagccaatcatttcttcactgtaactgaccccaggaacattctgttaaccaacgaacaactcgagagtgcgagaaaaatagtacatgattacaggcaaggaattgttcctcctggtcttacagaaaatgaattgtggagagcaaagtacatctatgattcagcttttcatcctgacactggtgagaagatgattttgataggaagaatgtcagcccaggttcccatgaacatgaccatcacaggttgtatgatgacgttttacaggactacgccggctgtgctgttctggcagtggattaaccagtccttcaatgccgtcgtcaattacaccaacagaagtggagacgcacccctcactgtcaatgagttgggaacagcttacgtttctgcaacaactggtgccgtagcaacagctctaggactcaatgcattgaccaagcatgtctcaccactgataggacgttttgttccctttgctgccgtagctgctgctaattgcattaatattccattaatgaggcaaagggaactcaaagttggcattcccgtcacggatgagaatgggaaccgcttgggggagtcggcgaacgctgcgaaacaagccatcacgcaagttgtcgtgtccaggattctcatggcagcccctggcatgggttagcaggactttgtcatttattccataaatacaggttgaaccagcgttcacggatccgtgaaccagaaaacaaacacatatatcacacctcttagtggaaattgccttccactgggggtggcagaaaataaacaagtaaata

SEQ ID NO: 308378 - DNA, 1173 bp, Homo sapiens
aaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttgcactgagcgggacctgcgagcagcgcgggcggcagcccgggggaagcgtccgggaccatgtctggagaactaccaccaaacattaacatcaaggaacctcgatgggatcaaagcactttcattggacgagccaatcatttcttcactgtaactgaccccaggaacattctgttaaccaacgaacaactcgagagtgcgagaaaaatagtacatgattacaggcaaggaattgttcctcctggtcttacagaaaatgaattgtggagagcaaagtacatctatgattcagcttttcatcctgacactggtgagaagatgattttgataggaagaatgtcagcccaggttcccatgaacatgaccatcacaggttgtatgatgacgttttacaggactacgccggctgtgctgttctggcagtggattaaccagtccttcaatgccgtcgtcaattacaccaacagaagtggagacgcacccctcactgtcaagtaaggctacgagaattgaccactctctgcagttcttcaaccttcattttattaagtggtgatactctcctgtttaaaaaagcctatgtgtgcatatttttatattgttcagaatattatgtagcatccttttttgtagcttttttcttttttaaagtaaagtgtttcattttctctctccctatcaagaaaacagtcttcttccagcctgccttctcagacattactcgtgcctttggaggtactggtaggatgttacctccttctcaccctggagctcatggccctgtagaacacatggcaggcagcaccggcctggcctctgataagtgacaggctgttccgccatctaccctgcctgagttgacagacaccaacgttaagagtagaggagacaaagtgtggtctctgcagaaatcaaggggagaccatggcggtgtgaactttatatctgatatgtttttaaaatagctcatctgtggagtccaaaagaaagcaatgagttttaattttttgtcacctgtt

SEQ ID NO: 308379 - DNA, 453 bp, Homo sapiens
ctcagcctcccaaagtgctgggattacagacgtaagccaccacacccagccagagcataaacttttaaaaccttgtagccacttgtctctaggacactggggagatatttgaaatgagcaattgccatattatttgttgttttcttaggcaaggaattgttcctcctggtcttacagaaaatgaattgtggagagcaaagtacatctatgattcagcttttcatcctgacactggtgagaagatgattttgataggaagaatgtcagcccaggttcccatgaacatgaccatcacaggttgtatgatgacgttttacaggtatgttatgaatatgtagcaacagtgtgtttaccattacagaagctcaaagtatatttttgtatgtaaataattttgttgaaataagtattatttcataagtatatgaagtgacaaacaaggtaattagcttg

SEQ ID NO: 308380 - DNA, 397 bp, Homo sapiens
tgagttgggaacagcttacgtttctgcaacaactggtgccgtagcaacagctctaggactcaatgcattgaccaaggtactcagatttttatttccataataaagctgtttaatttgttatcacctgcctggctctaaatccctctattatttcttaaactagttcaagtcatatggctttcttgttatagtgcttatcttcagctgcatattttagttatatcttccaataagtttgggaagagttgtcaccagtaacacctaccaggactgtggtctgtgcctgactctgtgtacgaagtgctaaatgttcacccatcctgacagcccaccagaggcattgcagagggcagtgtgcctcaggccacagctctgaagagaggcaagagcatctctc

SEQ ID NO: 308381 - DNA, 2072 bp, Homo sapiens
acgctccgggcctccaggtctcgcaggccccgccccctcgccgcgggttcgctgttgggcggagatattcgccgccggcgcttgcgcccggaaggtgtgccgcaccacacgggggaggaaggaaggagctcccaactcgccggcctggccacgggatggcccccaaattcccagactctgtggaggagctccgcgccgccggcaatgagagtttccgcaacggccagtacgccgaggcctccgcgctctacggccgcgcgctgcgggtgctgcaggcgcaaggttcttcagacccagaagaagaaagtgttctctactccaaccgagcagcatgtcacttgaaggatggaaactgcagagactgcatcaaagattgcacttcagcactggccttggttcccttcagcattaagcccctgctgcggcgagcatctgcttatgaggctctggagaagtaccctatggcctatgttgactataagactgtgctgcagattgatgataatgtgacgtcagccgtagaaggcatcaacagaatgaccagagctctcatggactcgcttgggcctgagtggcgcctgaagctgccctcaatccccttggtgcctgtttcagctcagaagaggtggaattccttgccttcggagaaccacaaagagatggctaaaagcaaatccaaagaaaccacagctacaaagaacagagtgccttctgctggggatgtggagaaagccagagttctgaaggaagaaggcaatgagcttgtaaagaagggaaaccataagaaagctattgagaagtacagtgaaagcctcttgtgtagtaacctggaatctgccacgtacagcaacagagcactctgctatttggtcctgaagcagtacacagaagcagtgaaggactgcacagaagccctcaagctggatggaaagaacgtgaaggcattctacagacgggctcaagcccacaaagcactcaaggactataaatccagctttgcagacatcagcaacctcctacagattgagcctaggaatggtcctgcacagaagttgcggcaggaagtgaagcagaacctacactaaaaacccaacagggcaactggaacccctgcctgaccttacccagagaagccatgggccacctgctctgtgcccgctcctgaaacccagcatgccccaagtgagctctgaagccccctcctcaatcccttgatggcctcccaccctgtaagaggctttgcttgttcaaattaaactcagtgtagtcaaacacagacatggttgttgcaccagaaaggtccccactagagctaagcgtgaagctgaagctctgtccctattcccccagcccagctagctgatcacaccaacagatcctcatcagcaaagcatttggctttgtcctgcccaagtgggctgcagactgagtgctgcccttgtagcttccccagaccccaactcactgcagttcatctgaacaacctgagctcctgggccggggtggaaggagggggataaacctaaggccctgatccaaagcagcctgttgagctggttctccagggctgcagtctctccaggtgtacagctgctgtccctgccctgtcctgtccttgcacagtctcctatgtctgagccccagtgccttctgttcgggccctcctttggtgggaaggcagagccctgacccttgaatggttgtccttgactctgtgctgctgccttctgcagagaggcacctaagctgtttaaagagcccagtgattgtggctgctcctcctagaggtgggagggggcaagaggcctccttggtcagtgtccatgctttctgggcagggacttggttttttgttccaacagtggccttctccgggcttcatagttctttgtaatatgttgaagttaatttgaattgactgattttgttgaactgtgtgtttaagctgttgcattaaaaagctttcttctacatcaatatctgctgtgctttcatttatgccttttcagctttgcacctggaactctgtagtaataataaaagttattgcttattgggcattcattcatttg

SEQ ID NO: 308382 - DNA, 2461 bp, Homo sapiens
acgctccgggcctccaggtctcgcaggccccgccccctcgccgcgggttcgctgttgggcggagatattcgccgccggcgcttgcgcccggaaggtgtgccgcaccacacgggggaggaaggaaggagctcccaactcgccggcctggccacgggatggcccccaaattcccagactctgtggaggagctccgcgccgccggcaatgagagtttccgcaacggccagtacgccgaggcctccgcgctctacggccgcgcgctgcgggtgctgcaggcgcaaggttcttcagacccagaagaagaaagtgttctctactccaaccgagcagcatgtcacttgaaggatggaaactgcagagactgcatcaaagattgcacttcagcactggccttggttcccttcagcattaagcccctgctgcggcgagcatctgcttatgaggctctggagaagtaccctatggcctatgttgactataagactgtgctgcagattgatgataatgtgacgtcagccgtagaaggcatcaacagaatgaccagagctctcatggactcgcttgggcctgagtggcgcctgaagctgccctcaatccccttggtgcctgtttcagctcagaagaggtggaattccttgccttcggagaaccacaaagagatggctaaaagcaaatccaaagaaaccacagctacaaagaacagagtgccttctgctggggatgtggagaaagccagagttctgaaggaagaaggcaatgagcttgtaaagaagggaaaccataagaaagctattgagaagtacagtgaaagcctcttgtgtagtaacctggaatctgccacgtacagcaacagagcactctgctatttggtcctgaagcagtacacagaagcagtgaaggactgcacagaagccctcaagctggatggaaagaacgtgaaggcattctacagacgggctcaagcccacaaagcactcaaggactataaatccagctttgcagacatcagcaacctcctacagattgagcctaggaatggtcctgcacagaagttgcggcaggaagtgaagcagaacctacactaaaaacccaacagggcaactggaacccctgcctgaccttacccagagaagccatgggccacctgctctgtgcccgctcctgaaacccagcatgccccaagtgagctctgaagccccctcctcaatcccttgatggcctcccaccctgtaagaggctttgcttgttcaaattaaactcagtgtagtcaaacacagacatggttgttgcaccagaaaggtccccactagagctaagcgtgaagctgaagctctgtccctattcccccagcccagctagctgatcacaccaacagatcctcatcagcaaagcatttggctttgtcctgcccaagtgggctgcagactgagtgctgcccttgtagcttccccagaccccaactcactgcagttcatctgaacaacctgagctcctgggccggggtggaaggagggggataaacctaaggccctgatccaaagcagcctgttgagctggttctccagggctgcagtctctccaggtgtacagctgctgtccctgccctgtcctgtccttgcacagtctcctatgtctgagccccagtgccttctgttcgggccctcctttggtgggaaggcagagccctgacccttgaatggttgtccttgactctgtgctgctgccttctgcagagaggcacctaagctgtttaaagagcccagtgattgtggctgctcctcctagaggtgggagggggcaagaggcctccttggtcagtgtccatgctttctgggcagggacttggttttttgttccaacagtggccttctccgggcttcatagttctttgtaatatgttgaagttaatttgaattgactgattttgttgaactgtgtgtttaagctgttgcattaaaaagctttcttctacatcaaaaaaaaaaaaaaaaaaaaaaaaacagaaactaaaaaaacaaaaaatacaacaacaaacacaacaacaacaaaaaaagggggcgcggcccttaataaattaaacacacgggggggccaccagtagtgacgcaaccacgcatgttttataaagaaggcgtcccaatatggaggcacaaaatataaagcaaacagacaaggcggccaccctaaatcacacaaagatgagagggggaaaaagccggaaacgggccgccctgaggagaggacccccttcaacagtagggagggggaacgcacaacacaaaaagcggggcaaccaccaccactcccaagaagcaaacagaagcagccctacgagagagtatcatatacaacactctcacggcctataccggggatcacacaacacggaagcaatattcgtacgccgctgtagacaaaagaccaacactaggagactatctccccctgcaaaattttaacg

SEQ ID NO: 308383 - DNA, 2103 bp, Homo sapiens
acgctccgggcctccaggtctcgcaggccccgccccctcgccgcgggttcgctgttgggcggagatattcgccgccggcgcttgcgcccggaaggtgtgccgcaccacacgggggaggaaggaaggagctcccaactcgccggcctggccacgggatggcccccaaattcccagactctgtggaggagctccgcgccgccggcaatgagagtttccgcaacggccagtacgccgaggcctccgcgctctacggccgcgcgctgcgggtgctgcaggcgcaaggttcttcagacccagaagaagaaagtgttctctactccaaccgagcagcatgtcacttgaaggatggaaactgcagagactgcatcaaagattgcacttcagcactggccttggttcccttcagcattaagcccctgctgcggcgagcatctgcttatgaggctctggagaagtaccctatggcctatgttgactataagactgtgctgcagattgatgataatgtgacgtcagccgtagaaggcatcaacagaatgaccagagctctcatggactcgcttgggcctgagtggcgcctgaagctgccctcaatccccttggtgcctgtttcagctcagaagaggtggaattccttgccttcggagaaccacaaagagatggctaaaagcaaatccaaagaaaccacagctacaaagaacagagtgccttctgctggggatgtggagaaagccagagttctgaaggaagaaggcaatgagcttgtaaagaagggaaaccataagaaagctattgagaagtacagtgaaagcctcttgtgtagtaacctggaatctgccacgtacagcaacagagcactctgctatttggtcctgaagcagtacacagaagcagtgaaggactgcacagaagccctcaagctggatggaaagaacgtgaaggcattctacagacgggctcaagcccacaaagcactcaaggactataaatccagctttgcagacatcagcaacctcctacagattgagcctaggaatggtcctgcacagaagttgcggcaggaagtgaagcagaacctacactaaaaacccaacagggcaactggaacccctgcctgaccttacccagagaagccatgggccacctgctctgtgcccgctcctgaaacccagcatgccccaagtgagctctgaagccccctcctcaatcccttgatggcctcccaccctgtaagaggctttgcttgttcaaattaaactcagtgtagtcaaacacagacatggttgttgcaccagaaaggtccccactagagctaagcgtgaagctgaagctctgtccctattcccccagcccagctagctgatcacaccaacagatcctcatcagcaaagcatttggctttgtcctgcccaagtgggctgcagactgagtgctgcccttgtagcttccccagaccccaactcactgcagttcatctgaacaacctgagctcctgggccggggtggaaggagggggataaacctaaggccctgatccaaagcagcctgttgagctggttctccagggctgcagtctctccaggtgtacagctgctgtccctgccctgtcctgtccttgcacagtctcctatgtctgagccccagtgccttctgttcgggccctcctttggtgggaaggcagagccctgacccttgaatggttgtccttgactctgtgctgctgccttctgcagagaggcacctaagctgtttaaagagcccagtgattgtggctgctcctcctagaggtgggagggggcaagaggcctccttggtcagtgtccatgctttctgggcagggacttggttttttgttccaacagtggccttctccgggcttcatagttctttgtaatatgttgaagttaatttgaattgactgattttgttgaactgtgtgtttaagctgttgcattaaaaagctttcttctacatcgttccaacagtggccttctccgggcttcatagttctttgtaatatgttgaagttaatttgaattgactgattttgttgaactgtgtgtttaagctgttgcattaaaaagctttcttctacatcaaaaa

SEQ ID NO: 308384 - DNA, 1902 bp, Homo sapiens
cgaagcggaaaaaacccccatactcagtaagccgggttgtaatcggacgaggcacctcccaactcgccggcctggccacgggatggcccccaaattcccagactctgtggaggagctccgcgccgccggcaatgagagtttccgcaacggccagtacgccgaggcctccgcgctctacggccgcgcgctgcgggtgctgcaggcgcaaggttcttcagacccagaagaagaaagtgttctctactccaaccgagcagcatgtcacttgaaggatggaaactgcagagactgcatcaaagattgcacttcagcactggccttggttcccttcagcattaagcccctgctgcggcgagcatctgcttatgaggctctggagaagtaccctatggcctatgttgactataagactgtgctgcagattgatgataatgtgacgtcagccgtagaaggcatcaacagaatgaccagagctctcatggactcgcttgggcctgagtggcgcctgaagctgccctcaatccccttggtgcctgtttcagctcagaagaggtggaattccttgccttcggagaaccacaaagagatggctaaaagcaaatccaaagaaaccacagctacaaagaacagagtgccttctgctggggatgtggagaaagccagagttctgaaggaagaaggcaatgagcttgtaaagaagggaaaccataagaaagctattgagaagtacagtgaaagcctcttgtgtagtaacctggaatctgccacgtacagcaacagagcactctgctatttggtcctgaagcagtacacagaagcagtgaaggactgcacagaagccctcaagctggatggaaagaacgtgaaggcattctacagacgggctcaagcccacaaagcactcaaggactataaatccagctttgcagacatcagcaacctcctacagattgagcctaggaatggtcctgcacagaagttgcggcaggaagtgaagcagaacctacactaaaaacccaacagggcaactggaacccctgcctgaccttacccagagaagccatgggccacctgctctgtgcccgctcctgaaacccagcatgccccaagtgagctctgaagccccctcctcaatcccttgatggcctcccaccctgtaagaggctttgcttgttcaaattaaactcagtgtagtcaaacacagacatggttgttgcaccagaaaggtccccactagagctaagcgtgaagctgaagctctgtccctattcccccagcccagctagctgatcacaccaacagatcctcatcagcaaagcatttggctttgtcctgcccaagtgggctgcagactgagtgctgcccttgtagcttccccagaccccaactcactgcagttcatctgaacaacctgagctcctgggccggggtggaaggagggggataaacctaaggccctgatccaaagcagcctgttgagctggttctccagggctgcagtctctccaggtgtacagctgctgtccctgccctgtcctgtccttgcacagtctcctatgtctgagccccagtgccttctgttcgggccctcctttggtgggaaggcagagccctgacccttgaatggttgtccttgactctgtgctgctgccttctgcagagaggcacctaagctgtttaaagagcccagtgattgtggctgctcctcctagaggtgggagggggcaagaggcctccttggtcagtgtccatgctttctgggcagggacttggttttttgttccaacagtggccttctccgggcttcatagttctttgtaatatgttgaagttaatttgaattgactgattttgttgaactgtgtgtttaagctgttgcattaaaaagctttcttctacatc

SEQ ID NO: 308385 - DNA, 1654 bp, Homo sapiens
ctggtgttctagaggatcccagaaggatggagacgcaaagacgcatcaaagattgcacttcagcactggccttggttcccttcagcattaagcccctgctgcggcgagcatctgcttatgaggctctggagaagtaccctatggcctatgttgactataagactgtgctgcagattgatgataatgtgacgtcagccgtagaaggcatcaacagaatgaccagagctctcatggactcgcttgggcctgagtggcgcctgaagctgccctcaatccccttggtgcctgtttcagctcagaagaggtggaattccttgccttcggagaaccacaaagagatggctaaaagcaaatccaaagaaaccacagctacaaagaacagagtgccttctgctggggatgtggagaaagccagagttctgaaggaagaaggcaatgagcttgtaaagaagggaaaccataagaaagctattgagaagtacagtgaaagcctcttgtgtagtaacctggaatctgccacgtacagcaacagagcactctgctatttggtcctgaagcagtacacagaagcagtgaaggactgcacagaagccctcaagctggatggaaagaacgtgaaggcattctacagacgggctcaagcccacaaagcactcaaggactataaatccagctttgcagacatcagcaacctcctacagattgagcctaggaatggtcctgcacagaagttgcggcaggaagtgaagcagaacctacactaaaaacccaacagggcaactggaacccctgcctgaccttacccagagaagccatgggccacctgctctgtgcccgctcctgaaacccagcatgccccaagtgagctctgaagccccctcctcaatcccttgatggcctcccaccctgtaagaggctttgcttgttcaaattaaactcagtgtagtcaaacacagacatggttgttgcaccagaaaggtccccactagagctaagcgtgaagctgaagctctgtccctattcccccagcccagctagctgatcacaccaacagatcctcatcagcaaagcatttggctttgtcctgcccaagtgggctgcagactgagtgctgcccttgtagcttccccagaccccaactcactgcagttcatctgaacaacctgagctcctgggccggggtggaaggagggggataaacctaaggccctgatccaaagcagcctgttgagctggttctccagggctgcagtctctccaggtgtacagctgctgtccctgccctgtcctgtccttgcacagtctcctatgtctgagccccagtgccttctgttcgggccctcctttggtgggaaggcagagccctgacccttgaatggttgtccttgactctgtgctgctgccttctgcagagaggcacctaagctgtttaaagagcccagtgattgtggctgctcctcctagaggtgggagggggcaagaggcctccttggtcagtgtccatgctttctgggcagggacttggttttttgttccaacagtggccttctccgggcttcatagttctttgtaatatgttgaagttaatttgaattgactgattttgttgaactgtgtgtttaagctgttgcattaaaaagctttcttctacatc

SEQ ID NO: 308386 - DNA, 1906 bp, Homo sapiens
  misc_feature (124)..(125): n is a, c, g, or t
  misc_feature (143)..(144): n is a, c, g, or t
  misc_feature (160)..(161): n is a, c, g, or t
  misc_feature (165)..(166): n is a, c, g, or t
  misc_feature (169)..(169): n is a, c, g, or t
  misc_feature (171)..(173): n is a, c, g, or t
  misc_feature (175)..(175): n is a, c, g, or t
  misc_feature (180)..(180): n is a, c, g, or t
  misc_feature (184)..(184): n is a, c, g, or t
  misc_feature (188)..(188): n is a, c, g, or t
  misc_feature (190)..(190): n is a, c, g, or t
  misc_feature (206)..(206): n is a, c, g, or t
  misc_feature (298)..(298): n is a, c, g, or t
  misc_feature (300)..(300): n is a, c, g, or t
  misc_feature (343)..(343): n is a, c, g, or t
  misc_feature (346)..(346): n is a, c, g, or t
  misc_feature (359)..(359): n is a, c, g, or t
  misc_feature (361)..(361): n is a, c, g, or t
  misc_feature (378)..(378): n is a, c, g, or t
  misc_feature (380)..(382): n is a, c, g, or t
  misc_feature (386)..(386): n is a, c, g, or t
  misc_feature (388)..(388): n is a, c, g, or t
  misc_feature (393)..(393): n is a, c, g, or t
  misc_feature (398)..(398): n is a, c, g, or t
  misc_feature (400)..(400): n is a, c, g, or t
  misc_feature (409)..(409): n is a, c, g, or t
  misc_feature (414)..(415): n is a, c, g, or t
  misc_feature (420)..(420): n is a, c, g, or t
  misc_feature (426)..(426): n is a, c, g, or t
  misc_feature (436)..(436): n is a, c, g, or t
  misc_feature (442)..(442): n is a, c, g, or t
  misc_feature (446)..(446): n is a, c, g, or t
cgaagcggaaaaaacccccatactcagtaagccgggttgtaatcggacgaggcacctcccaactcgccggcctggccacgggatggcccccaaattcccagactctgtggaggagctccgctcnnttgtcaatttgatttttnnttacggccatttcgcnntggnnttntnnntnttttntttntcgntncgggtttttttggcgntatgtttttttttttcataataagatatttttttttttttttttttttttttctttttttttttttttttttatattttatatatttttttntntttttttttttttatcttttttttttttttttttttttttttntcntctttttcggtgntnattttttttttttgttntnnnttantnccctntggcntnttttttttnttttnnttttntgcagntttatgatantttttnttcntccgtagaaggcatcaacagaatgaccagagctctcatggactcgcttgggcctgagtggcgcctgaagctgccctcaatccccttggtgcctgtttcagctcagaagaggtggaattccttgccttcggagaaccacaaagagatggctaaaagcaaatccaaagaaaccacagctacaaagaacagagtgccttctgctggggatgtggagaaagccagagttctgaaggaagaaggcaatgagcttgtaaagaagggaaaccataagaaagctattgagaagtacagtgaaagcctcttgtgtagtaacctggaatctgccacgtacagcaacagagcactctgctatttggtcctgaagcagtacacagaagcagtgaaggactgcacagaagccctcaagctggatggaaagaacgtgaaggcattctacagacgggctcaagcccacaaagcactcaaggactataaatccagctttgcagacatcagcaacctcctacagattgagcctaggaatggtcctgcacagaagttgcggcaggaagtgaagcagaacctacactaaaaacccaacagggcaactggaacccctgcctgaccttacccagagaagccatgggccacctgctctgtgcccgctcctgaaacccagcatgccccaagtgagctctgaagccccctcctcaatcccttgatggcctcccaccctgtaagaggctttgcttgttcaaattaaactcagtgtagtcaaacacagacatggttgttgcaccagaaaggtccccactagagctaagcgtgaagctgaagctctgtccctattcccccagcccagctagctgatcacaccaacagatcctcatcagcaaagcatttggctttgtcctgcccaagtgggctgcagactgagtgctgcccttgtagcttccccagaccccaactcactgcagttcatctgaacaacctgagctcctgggccggggtggaaggagggggataaacctaaggccctgatccaaagcagcctgttgagctggttctccagggctgcagtctctccaggtgtacagctgctgtccctgccctgtcctgtccttgcacagtctcctatgtctgagccccagtgccttctgttcgggccctcctttggtgggaaggcagagccctgacccttgaatggttgtccttgactctgtgctgctgccttctgcagagaggcacctaagctgtttaaagagcccagtgattgtggctgctcctcctagaggtgggagggggcaagaggcctccttggtcagtgtccatgctttctgggcagggacttggttttttgttccaacagtggccttctccgggcttcatagttctttgtaatatgttgaagttaatttgaattgactgattttgttgaactgtgtgtttaagctgttgcattaaaaagctttcttctacatc

SEQ ID NO: 308387 - DNA, 1827 bp, Homo sapiens
acgctccgggcctccaggtctcgcaggccccgccccctcgccgcgggttcgctgttgggcggagatattcgccgccggcgcttgcgcccggaaggtgtgccgcaccacacgggggaggaaggaaggagctcccaactcgccggcctggccacgggatggcccccaaattcccagactctgtggaggagctccgcgccgccggcaatgagagtttccgcaacggccagtacgccgaggcctccgcgctctacggccgcgcgctgcgggtgctgcaggcgcaaggttcttcagacccagaagaagaaagtgttctctactccaaccgagcagcatgtcacttgaaggatggaaactgcagagactgcatcaaagattgcacttcagcactggccttggttcccttcagcattaagcccctgctgcggcgagcatctgcttatgaggctctggagaagtaccctatggcctatgttgactataagactgtgctgcagattgatgataatgtgacgtcagccgtagaaggcatcaacagaatgaccagagctctcatggactcgcttgggcctgagtggcgcctgaagctgccctcaatccccttggtgcctgtttcagctcagaagaggtggaattccttgccttcggagaaccacaaagagatggctaaaagcaaatccaaagaaaccacagctacaaagaacagagagcactctgctatttggtcctgaagcagtacacagaagcagtgaaggactgcacagaagccctcaagctggatggaaagaacgtgaaggcattctacagacgggctcaagcccacaaagcactcaaggactataaatccagctttgcagacatcagcaacctcctacagattgagcctaggaatggtcctgcacagaagttgcggcaggaagtgaagcagaacctacactaaaaacccaacagggcaactggaacccctgcctgaccttacccagagaagccatgggccacctgctctgtgcccgctcctgaaacccagcatgccccaagtgagctctgaagccccctcctcaatcccttgatggcctcccaccctgtaagaggctttgcttgttcaaattaaactcagtgtagtcaaacacagacatggttgttgcaccagaaaggtccccactagagctaagcgtgaagctgaagctctgtccctattcccccagcccagctagctgatcacaccaacagatcctcatcagcaaagcatttggctttgtcctgcccaagtgggctgcagactgagtgctgcccttgtagcttccccagaccccaactcactgcagttcatctgaacaacctgagctcctgggccggggtggaaggagggggataaacctaaggccctgatccaaagcagcctgttgagctggttctccagggctgcagtctctccaggtgtacagctgctgtccctgccctgtcctgtccttgcacagtctcctatgtctgagccccagtgccttctgttcgggccctcctttggtgggaaggcagagccctgacccttgaatggttgtccttgactctgtgctgctgccttctgcagagaggcacctaagctgtttaaagagcccagtgattgtggctgctcctcctagaggtgggagggggcaagaggcctccttggtcagtgtccatgctttctgggcagggacttggttttttgttccaacagtggccttctccgggcttcatagttctttgtaatatgttgaagttaatttgaattgactgattttgttgaactgtgtgtttaagctgttgcattaaaaagctttcttctacatc

SEQ ID NO: 308388 - DNA, 1554 bp, Homo sapiens
aaggctagaacctgggttgctttttatcatttatatatttttatgtgcatgcaaaaatgtttttatatcaggattccccaacttcttgatgaaaaactgttgaattgcccagaagctattaattgggggaagtcattaatcaggaaggatgatttacagcaggggaggaaatctctgggagagaggattgtagtcagtttggaagggacgatgctgaagagacctcactgatctcagttgggtgctgctccatggtttttttcctcttctgaatttgtatctagtgccttctgctggggatgtggagaaagccagagttctgaaggaagaaggcaatgagcttgtaaagaagggaaaccataagaaagctattgagaagtacagtgaaagcctcttgtgtagtaacctggaatctgccacgtacagcaacagagcactctgctatttggtcctgaagcagtacacagaagcagtgaaggactgcacagaagccctcaagctggatggaaagaacgtgaaggcattctacagacgggctcaagcccacaaagcactcaaggactataaatccagctttgcagacatcagcaacctcctacagattgagcctaggaatggtcctgcacagaagttgcggcaggaagtgaagcagaacctacactaaaaacccaacagggcaactggaacccctgcctgaccttacccagagaagccatgggccacctgctctgtgcccgctcctgaaacccagcatgccccaagtgagctctgaagccccctcctcaatcccttgatggcctcccaccctgtaagaggctttgcttgttcaaattaaactcagtgtagtcaaacacagacatggttgttgcaccagaaaggtccccactagagctaagcgtgaagctgaagctctgtccctattcccccagcccagctagctgatcacaccaacagatcctcatcagcaaagcatttggctttgtcctgcccaagtgggctgcagactgagtgctgcccttgtagcttccccagaccccaactcactgcagttcatctgaacaacctgagctcctgggccggggtggaaggagggggataaacctaaggccctgatccaaagcagcctgttgagctggttctccagggctgcagtctctccaggtgtacagctgctgtccctgccctgtcctgtccttgcacagtctcctatgtctgagccccagtgccttctgttcgggccctcctttggtgggaaggcagagccctgacccttgaatggttgtccttgactctgtgctgctgccttctgcagagaggcacctaagctgtttaaagagcccagtgattgtggctgctcctcctagaggtgggagggggcaagaggcctccttggtcagtgtccatgctttctgggcagggacttggttttttgttccaacagtggccttctccgggcttcatagttctttgtaatatgttgaagttaatttgaattgactgattttgttgaactgtgtgtttaagctgttgcattaaaaagctttcttctacatc

SEQ ID NO: 308389 - DNA, 628 bp, Homo sapiens
aacaaaatgtatgattctttcttggagaaactatagtctttttggatcatggtttaagtatccttaacaagcaacagatcaccactttaaaggtaacatagtttgaccaagctcaaggaatgtcatggggactgatctgagatggtgtttatgggttcctgtattgcacgtgttggaggagctaaagaggtggttccgaccagggggagggtggcagctctggctcttctgaaaaggcctacctcccatgggtgtgtgaaaggagaaatatcttcttgacccagctggaaacctccctgcaatcctgccttcttttccagaatgaccagagctctcatggactcgcttgggcctgagtggcgcctgaagctgccctcaatccccttggtgcctgtttcagctcagaagaggtggaattccttgccttcggagaaccacaaagagatggctaaaagcaaatccaaagaaaccacagctacaaagaacagaggtgagctgtgactccctgcccagagtcttgcaatctcccactatccattttctttagagtagtcctgcaaaaattggcattgtttagctgagttataaaaataatcttaggaacaaagtataaaacaaaatacaagtc
